(12) United States Patent
Gegg, Jr. et al.

(10) Patent No.: US 8,168,592 B2
(45) Date of Patent: *May 1, 2012

(54) CGRP PEPTIDE ANTAGONISTS AND CONJUGATES

(75) Inventors: Colin V. Gegg, Jr., Newbury Park, CA (US); Eileen J. Johnson, Newbury Park, CA (US); Leslie P. Miranda, Thousand Oaks, CA (US); Kenneth W. Walker, Newbury Park, CA (US); Jerry Ryan Holder, Simi Valley, CA (US); Marie E. Wright, Westlake Village, CA (US); Derin C. D'Amico, Newbury Park, CA (US)

(73) Assignee: Amgen Inc., Thousand Oaks, CA (US)

( * ) Notice: Subject to any disclaimer, the term of this patent is extended or adjusted under 35 U.S.C. 154(b) by 1078 days.

This patent is subject to a terminal disclaimer.

(21) Appl. No.: 11/584,177

(22) Filed: Oct. 19, 2006

(65) Prior Publication Data

US 2008/0020978 A1   Jan. 24, 2008

Related U.S. Application Data

(60) Provisional application No. 60/729,083, filed on Oct. 21, 2005.

(51) Int. Cl.
  *A61K 38/00* (2006.01)
  *A61P 43/00* (2006.01)
(52) U.S. Cl. ............... 514/12; 514/2; 530/300; 424/9.1
(58) Field of Classification Search ................ 514/2, 12; 530/300; 424/9.1
  See application file for complete search history.

(56) References Cited

U.S. PATENT DOCUMENTS

| | | | |
|---|---|---|---|
| 4,116,768 A | 9/1978 | Isowa et al. | |
| 4,179,337 A | 12/1979 | Davis et al. | |
| 4,331,592 A | 5/1982 | Wissmann et al. | |
| 4,367,225 A | 1/1983 | Manning et al. | |
| 4,530,838 A | 7/1985 | Evans et al. | |
| 4,549,986 A | 10/1985 | Evans et al. | |
| 4,687,839 A | 8/1987 | Kempe | |
| 4,697,002 A | 9/1987 | Kempe | |
| 4,709,012 A | 11/1987 | Adams et al. | |
| 4,720,483 A | 1/1988 | Jansz et al. | |
| 4,736,023 A | 4/1988 | Evans et al. | |
| 4,766,106 A | 8/1988 | Katre et al. | |
| 4,778,878 A | 10/1988 | Adams et al. | |
| 4,847,325 A | 7/1989 | Shadle et al. | |
| 4,904,584 A | 2/1990 | Shaw | |
| 5,166,322 A | 11/1992 | Shaw et al. | |
| 5,183,660 A | 2/1993 | Ikeda et al. | |
| 5,206,344 A | 4/1993 | Katre et al. | |
| 5,214,030 A | 5/1993 | Stief | |
| 5,252,714 A | 10/1993 | Harris et al. | |
| 5,266,561 A | 11/1993 | Cooper et al. | |
| 5,280,014 A | 1/1994 | Cooper et al. | |
| 5,281,581 A | 1/1994 | Cooper et al. | |
| 5,318,897 A | 6/1994 | Paul | |
| 5,364,841 A | 11/1994 | Cooper et al. | |
| 5,576,290 A | 11/1996 | Hadley | |
| 5,580,953 A | 12/1996 | Albrecht et al. | |
| 5,612,034 A | 3/1997 | Pouletty et al. | |
| 5,625,032 A | 4/1997 | Gaeta et al. | |
| 5,637,309 A | 6/1997 | Tajima et al. | |
| 5,672,584 A | 9/1997 | Borchardt et al. | |
| 5,686,411 A | 11/1997 | Gaeta et al. | |
| 5,714,142 A | 2/1998 | Blaney et al. | |
| 5,716,619 A | 2/1998 | Cooper et al. | |
| 5,739,106 A | 4/1998 | Rink et al. | |
| 5,824,784 A | 10/1998 | Kinstler et al. | |
| 5,840,733 A | 11/1998 | Krantz et al. | |
| 5,843,440 A | 12/1998 | Pouletty et al. | |
| 5,858,978 A | 1/1999 | Vignery | |
| 5,900,404 A | 5/1999 | Gegg et al. | |
| 5,932,215 A | 8/1999 | de Lacharriere et al. | |
| 5,935,586 A | 8/1999 | De Lacharriere et al. | |
| 5,942,227 A | 8/1999 | Cooper et al. | |
| 5,942,620 A | 8/1999 | Krantz et al. | |
| 5,951,972 A | 9/1999 | Daley et al. | |
| 5,958,877 A | 9/1999 | Wimalawansa | |
| 5,985,265 A | 11/1999 | Kinstler et al. | |
| 5,990,237 A | 11/1999 | Bentley et al. | |
| 5,998,367 A | 12/1999 | Gaeta et al. | |
| 6,010,999 A | 1/2000 | Daley et al. | |
| 6,019,967 A | 2/2000 | Breton et al. | |
| 6,033,884 A | 3/2000 | Woo et al. | |
| 6,048,717 A | 4/2000 | Paul et al. | |
| 6,087,375 A | 7/2000 | Bridon et al. | |
| 6,103,233 A | 8/2000 | Pouletty et al. | |
| 6,169,069 B1 | 1/2001 | de Lacharriere et al. | |
| 6,180,370 B1 | 1/2001 | Queen et al. | |
| 6,268,474 B1 | 7/2001 | Smith et al. | |
| 6,320,022 B1 | 11/2001 | Cutitta et al. | |
| 6,342,225 B1 | 1/2002 | Jones et al. | |
| 6,344,438 B1 | 2/2002 | de Lacharriere et al. | |
| 6,416,760 B2 | 7/2002 | Breton et al. | |
| 6,433,158 B1 | 8/2002 | Pettit | |
| 6,451,986 B1 | 9/2002 | Pettit | |
| 6,465,694 B1 | 10/2002 | Baudys et al. | |
| 6,479,265 B1 | 11/2002 | Napper et al. | |
| 6,500,918 B2 | 12/2002 | Ezrin et al. | |

(Continued)

FOREIGN PATENT DOCUMENTS

DE    197 32 944 A1    2/1999

(Continued)

OTHER PUBLICATIONS

Kurz, et al "Calcitonin Gene-Related Peptide and Its Receptor in the Thymus", *Peptides*, 16: 1497-1503 (1995).

(Continued)

*Primary Examiner* — Chih-Min Kam
(74) *Attorney, Agent, or Firm* — Nisan A. Steinberg

(57) ABSTRACT

Disclosed is a composition of matter that involves a CGRP peptide antagonist. A pharmaceutical composition is disclosed that comprises the composition of matter and a pharmaceutically acceptable carrier, which can be configured for administration to a patient. Also disclosed is a method of producing the composition of matter. Methods of treating, preventing or mitigating migraine, are also disclosed.

11 Claims, 11 Drawing Sheets

U.S. PATENT DOCUMENTS

| | | |
|---|---|---|
| 6,509,014 B1 | 1/2003 | de Lacharriere et al. |
| 6,521,609 B1 | 2/2003 | Doods et al. |
| 6,525,102 B1 | 2/2003 | Chen et al. |
| 6,548,644 B1 | 4/2003 | Pettit |
| 6,552,043 B1 | 4/2003 | Patchett et al. |
| 6,586,398 B1 | 7/2003 | Kinstler et al. |
| 6,602,498 B2 | 8/2003 | Shen |
| 6,656,730 B1 | 12/2003 | Manoharan |
| 6,660,843 B1 | 12/2003 | Feige et al. |
| 6,664,420 B2 | 12/2003 | Wells |
| 6,686,171 B2 | 2/2004 | Bronstein et al. |
| 6,743,429 B2 | 6/2004 | Cadieux |
| 6,756,205 B2 | 6/2004 | Smith et al. |
| 6,756,480 B2 | 6/2004 | Kostenuik et al. |
| 6,762,169 B1 | 7/2004 | Manoharan |
| 6,770,661 B2 | 8/2004 | Shao et al. |
| 6,824,782 B2 | 11/2004 | Whitlow et al. |
| 6,838,076 B2 | 1/2005 | Patton et al. |
| 6,849,714 B1 | 2/2005 | Bridon et al. |
| 6,867,210 B2 | 3/2005 | Hogenkamp et al. |
| 6,887,470 B1 | 5/2005 | Bridon et al. |
| 6,905,688 B2 | 6/2005 | Rosen et al. |
| 6,926,898 B2 | 8/2005 | Rosen et al. |
| 6,946,134 B1 | 9/2005 | Rosen et al. |
| 6,949,541 B2 | 9/2005 | Rudolf et al. |
| 6,953,790 B2 | 10/2005 | Burgey et al. |
| 6,962,899 B2 | 11/2005 | May et al. |
| 6,965,013 B2 | 11/2005 | Hsu |
| 6,989,365 B2 | 1/2006 | Fleer et al. |
| 7,101,853 B2 | 9/2006 | Young et al. |
| 2001/0051157 A1 | 12/2001 | Breton et al. |
| 2002/0009441 A1 | 1/2002 | Pouletty et al. |
| 2002/0018751 A1 | 2/2002 | Bridon et al. |
| 2002/0068814 A1 | 6/2002 | Smith et al. |
| 2002/0090646 A1 | 7/2002 | Liu et al. |
| 2002/0164707 A1 | 11/2002 | Adamou et al. |
| 2003/0069395 A1 | 4/2003 | Sato et al. |
| 2003/0153694 A1 | 8/2003 | Rosen et al. |
| 2003/0191056 A1 | 10/2003 | Walker et al. |
| 2003/0195154 A1 | 10/2003 | Walker et al. |
| 2003/0220235 A1 | 11/2003 | Nistri et al. |
| 2004/0038861 A1 | 2/2004 | Cooper et al. |
| 2004/0063735 A1 | 4/2004 | Chaturvedula et al. |
| 2004/0110170 A1 | 6/2004 | Pisegna et al. |
| 2004/0147687 A1 | 7/2004 | Rosen et al. |
| 2004/0175756 A1 | 9/2004 | Kolkman et al. |
| 2004/0204353 A1 | 10/2004 | Hsu |
| 2004/0229861 A1 | 11/2004 | Burgey et al. |
| 2005/0048512 A1 | 3/2005 | Kolkman et al. |
| 2005/0053973 A1 | 3/2005 | Kolkman et al. |
| 2005/0054051 A1 | 3/2005 | Rosen et al. |
| 2005/0089932 A1 | 4/2005 | Kolkman et al. |
| 2005/0215576 A1 | 9/2005 | Degnan et al. |
| 2005/0233980 A1 | 10/2005 | Doods et al. |
| 2005/0256098 A1 | 11/2005 | Burgey et al. |
| 2006/0122250 A1 | 6/2006 | Chaturvedula et al. |
| 2006/0148779 A1 | 7/2006 | Bell et al. |
| 2006/0173046 A1 | 8/2006 | Bell et al. |

FOREIGN PATENT DOCUMENTS

| | | |
|---|---|---|
| EP | 0 367 463 A1 | 10/1989 |
| EP | 0 385 712 B1 | 2/1990 |
| EP | 0 575 545 B1 | 5/2003 |
| EP | 1 493 748 A1 | 5/2005 |
| JP | 07118165 A | 5/1995 |
| JP | 10-316641 | 2/1998 |
| JP | 2001-242165 | 7/2001 |
| JP | 2002-3368 | 9/2002 |
| WO | WO 85/01658 A1 | 4/1985 |
| WO | WO 85/02840 A1 | 7/1985 |
| WO | WO 89/06135 A1 | 7/1989 |
| WO | WO 90/04605 A1 | 10/1989 |
| WO | WO 90/07005 A1 | 6/1990 |
| WO | WO 90/12815 A1 | 11/1990 |
| WO | WO 93/10146 A1 | 5/1993 |
| WO | WO 93/11787 A1 | 6/1993 |
| WO | WO 93/14408 A1 | 7/1993 |
| WO | WO 94/05317 A1 | 3/1994 |
| WO | WO 94/05321 A1 | 3/1994 |
| WO | WO 96/03993 A2 | 2/1996 |
| WO | WO 96/03993 A3 | 2/1996 |
| WO | WO 96/04928 A1 | 2/1996 |
| WO | WO 97/34922 A1 | 9/1997 |
| WO | WO 00/24697 A1 | 5/2000 |
| WO | WO 01/83526 A2 | 11/2001 |
| WO | WO 01/83526 A3 | 11/2001 |
| WO | WO 02/083734 A2 | 10/2002 |
| WO | WO 02/100352 A2 | 12/2002 |
| WO | WO 02/100352 A3 | 12/2002 |
| WO | WO 03/045424 A1 | 6/2003 |
| WO | WO 03/102180 A1 | 12/2003 |
| WO | WO 03/104236 A1 | 12/2003 |
| WO | WO 2004/037811 A1 | 5/2004 |
| WO | WO 2004/044011 A2 | 5/2004 |
| WO | WO 2004/060386 A1 | 7/2004 |
| WO | WO 2004/082602 A2 | 9/2004 |
| WO | WO 2004/082602 A3 | 9/2004 |
| WO | WO 2004/087649 A2 | 10/2004 |
| WO | WO 2004/091514 A2 | 10/2004 |
| WO | WO 2004/091514 A3 | 10/2004 |
| WO | WO 2004/092166 A2 | 10/2004 |
| WO | WO 2004/092166 A3 | 10/2004 |
| WO | WO 2004/092168 A1 | 10/2004 |
| WO | WO 2005/000807 A2 | 1/2005 |
| WO | WO 2005/000807 A3 | 1/2005 |
| WO | WO 2005/009962 A1 | 2/2005 |
| WO | WO 2005/013894 A2 | 2/2005 |
| WO | WO 2005/056550 A2 | 6/2005 |
| WO | WO 2005/056550 A3 | 6/2005 |
| WO | WO 2005/065779 A1 | 7/2005 |
| WO | WO 2005/072308 C2 | 8/2005 |
| WO | WO 2005/084672 A1 | 9/2005 |
| WO | WO 2005/092880 A1 | 10/2005 |
| WO | WO 2005/095383 A1 | 10/2005 |
| WO | WO 2005/100343 A1 | 10/2005 |
| WO | WO 2005/100352 A1 | 10/2005 |
| WO | WO 2005/100360 A1 | 10/2005 |
| WO | WO 2005/103037 A2 | 11/2005 |
| WO | WO 2006/029153 A2 | 3/2006 |
| WO | WO 2006/029153 A3 | 3/2006 |
| WO | WO 2006/041830 A2 | 4/2006 |
| WO | WO 2006/041830 A3 | 4/2006 |
| WO | WO 2006/044449 A2 | 4/2006 |
| WO | WO 2006/044449 A3 | 4/2006 |
| WO | WO 2006/044504 A1 | 4/2006 |
| WO | WO 2006/047196 A2 | 5/2006 |
| WO | WO 2006/060678 A2 | 6/2006 |

OTHER PUBLICATIONS

Lipton, et al, "CGRP antagonists in the acute treatment of migraine", *The Lancet-Neurology*, 3: 332 (2004).

Harris et al., "Effect of Pegylation on Pharmaceuticals", Nature Reviews/Drug Discovery, 2: 214-221 (2003).

Abuchowski, et al "Soluble Polymer-Enzyme Adducts", *Enzymes as Drugs*, Ch. 13: 367-383, 1981.

Adjei and Garren "Pulmonary Delivery of Peptide Drugs: Effect of Particle Size on Bioavailability of Leuprolide Acetate in Healthy Male Volunteers", *Pharm. Rsh.*, 7: 565-569, 1990.

Akerman, et al "The Role of Dopamine in a Model of Trigeminovascular Nociception", *Jnl. Pharmacol. and Experim. Therapeut.*, 314: 162-169 (2005).

Alpar, et al "Management of chronic pain in whiplash injury", *Jnl. of Bone & Joint Surgery*, 84-B: 807-811 (2002).

Aoki, et al "Disc inflammation potentially promotes axonal regeneration of dorsal root ganglion neurons innervating lumbar intervertebral disc in rats", *Spine*, 29: 2621-2626 (2004).

Barrett, et al "Determination of Protease Cleavage Site Motifs Mixture-Based Oriented Peptide Libraries", *Handbook of Proteolytic Enzymes* (1998).

Basser, et al "Thrombopoietic of pegylated recombinant human megakaryocyte growth and development factor (PEG-rHuMGDF) in patients with advanced cancer", *The Lancet*, 348: 1279-1281 (1996).

Beer, et al "Systemic neuropeptide levels as predictive indicators for lethal outcome in patients with postoperative sepsis", *Crit. Care. Med.*, 30: 1794-1798 (2002).

Bennett, et al, Eds. "Combinatorial & Solid Phase Organic Chemistry: A Guide to Principles, Products, & Protocols", *Adv. ChemTech Handbook*, Title Page and Table of Contents (1998).
Bergerot, et al, Review Article. "Animal models of migraine: looking at the component parts of a complex disorder", *Eur. Jnl. of Neurosc.*, 24: 1517-1534 (2006).
Bhatnager, et al "Structure-Activity Relationships of Novel Hematoregulatory Peptides", *Jnl. Med. Chem.*, 39: 3814-3819 (1996).
Biochem J., "Nomenclature and Symbolism for Amino Acids and Peptides" (IUPAC-IUB Joint Commission on Biochemical Nomenclature [JCBN]), 219: 345-373 (1984).
Birklein, et al "The important role of neuropeptides in complex regional pain syndrome", *Neurology*, 57: 2179-2184 (2001).
Bodanszky, et al "The Practice of Peptide Synthesis; Second, Revised Edition", *Springer Lab.*, Table of Contents (1994).
Bodanszky, M., "Principles of Peptide Synthesis; 2nd Edition", *Springer Lab.*, Table of Contents (1993).
Brain, et al "Evidence That Calcitonin Gene-Related Peptide Contributes to Inflammation in the Skin and Joint", *Ann. N. Y. Acad. Sci.*, 675: 412-419 (1992).
Braquet, et al "Effect of Endothelin-1 on Blood Pressure and Bronchopulmonary system of the Guinea Pig", *Jnl. of Cardiovas. Pharmac.*, S143-S146 (1989).
Carpenter, et al "Turn Structures in CGRP C-Terminal Analogues Promote Stable Arrangements of Key Residue Side Chains", *Biochem.*, 40: 8317-8325 (2001).
Caviedes-Bucheli, et al "Expression of Calcitonin Gene-Related Peptide (CGRP) in Irreversible Acute Pulpitis", *Jnl. of Endodont.*, 30: 201-204 (2004).
Chan, et al "Fmoc solid phase peptide synthesis: A Practical Approach", *Oxford Univ. Press*, Table of Contents (2000).
Chauhan, et al "Role of the N-Terminal Domain of the Calcitonin Receptor-like Receptor in Ligand Binding", *Biochem.*, 44: 782-789 (2005).
Chiba, et al "Calcitonin gene-related peptide receptor antagonist human CGRP-(8-37)" *Amer. Physiol. Soc.*, 256: E331-E335 (1989).
Christopoulos, et al "Multiple Amylin Receptors Arise from Receptor Activity-Modifying Protein Interaction with the Calcitonin Receptor Gene Product", *Mol. Pharmacol.*, 56: 235-242 (1999).
Connelly, et al "Neutral endopeptidase 24.11 in human neutrophils: Cleavage of chemotactic peptide", *Proc. Natl. Acad. Sci.*, 82: 8737-8741 (1985).
Conner, et al "A Key Role for Transmembrane Prolines in Calcitonin Receptor-Like Receptor Agonist Binding and Signalling: Implications for Family B G-Protein-Coupled Receptors", *Mol. Pharmacol.*, 67: 20-31 (2005).
Conner, et al "Interaction of calcitonin-gene-related peptide with its receptors", *Biochem. Soc. Transact.*, 30: part 4, 451-455 (2002).
Creighton, "Proteins: Structures and Molecular Principles", W.H. Freeman & Co., Pubs., 79-86, (1983).
Davis, et al "Preparation and Characterization of Antibodies with Specificity for the Amino-Terminal Tetrapeptide Sequence of the Platelet-Derived Connective Tissue Activating Peptide-III", *Biochem. Intl.*, 10: 395-404 (1985).
Debs, et al, "Lung-Specific Delivery of Cytokines Induces Sustained Pulmonary and Systemic Immunomodulation in Rats", *Jnl. of Immunol.*, 140: 3482-3488 (1988).
Delgado, et al, "The Uses and Properties of PEG-Linked Proteins", *Crit. Revs. in Therap. Drug Carrier Sys.*, 9: 249-304 (1992).
Dennis et al. "hCGRP$_{8-37}$ a Calcitonin Gene-Related Peptide Antagonist Revealing Calcitonin Gene-Related Peptide Receptor Heterogeneity in Brain and Periphery", *Jnl. of Pharm. and Experim. Therap.*, 254: 123-128 (1990).
Dennis et al, "Structure-Activity Profile of Calcitonin Gene-Related Peptide in Peripheral and Brain Tissues. Evidence for Receptor Multiplicity", *Jnl. of Pharm. and Experim. Therap.*, 251: 718-725 (1989).
Doods, H., "Development of CGRP antagonists for the treatment of migraine", *Curr. Opin. in Investig. Drugs*, 2:1261-8 (2001).
Dumont, et al, A Potent and Selective CRGP2 Agonist, [Cys(Et)$^{2,7}$]hCGRPα: Comparison in Prototypical CGRP$_1$ and CGRP$_2$ in vitro Bioassays[1], *Can. Jnl. Physiol. Pharmacol.*, 75: 671-676 (1997).

Durham, P. "CGRP-Receptor Antagonists—A Fresh Approach to Migraine Therapy?", *N. E. Jnl. Med.*, 350: 1073-1075 (2004).
Earnshaw, et al., "Mammalian Caspases: Structure, Activation, Substrates, and Functions During Apoptosis", *Ann. Rev. of Biochem.*, 68: 383-424 (1999).
Erickson, et al. "Solid-Phase Peptide Synthesis", *The Proteins*, (3rd ed.) 2: 257-527 (1976).
Felix, et al., "Pegylated Peptides IV: Enhanced Biological Activity of Site-Directed Pegylated GRF Analogs", *Int. Jnl. Peptide Protein Rsh.*, 46: 253-264 (1995).
Felix, A.M., "ACS Symposium Series 680: Site-specific poly(ethylene glycol)ylation of Peptides", Ch.16: 218-238 (1997).
Fields, et al, "3. Principles and Practice of Solid-Phase Peptide Synthesis", *Syn. Pep.: A User's Guide*, 77-183 (1992).
Finn et al., "The Synthesis of Peptides by Solution Methods with Emphasis on Peptide Hormones", *The Proteins (3rd ed.)* 2: 105-253 (1976).
Fraser et al., "The Amino Terminus of Receptor Activity Modifying Proteins Is a Critical Determinant of Glycosylation State and Ligand Binding of Calcitonin Receptor-Like Receptor", *Molec. Pharmacol.*, 55: 1054-1059 (1999).
Giovagnoli, et al "Biodegradable Microspheres as Carriers for Native Superoxide Dismutase and Catalase Delivery", *AAPS PharmSciTech.*, 5: 1-9 (2004).
Goodson, et al "Site-directed pegylation of recombinant interleukin-2 at its glycosylation site", *Bio/Technol.*, 8: 343-346 (1990).
Gorn, et al "Expression of Two Human Skeletal Calcitonin Receptor Isoforms Cloned from a Giant Cell Tumor of Bone", *Amer. Soc. for Clin. Investig.*, 95: 2680-2691 (1995).
Grant, G. A., "Synthetic Peptides: *A User's Guide*", W. H. Freeman and Co., New York, Table of Contents (1992).
Greene and Wutz (Eds.), "Protective Groups in Organic Synthesis. Third Edition", John Wiley & Sons, Inc., Table of Contents (1999).
Greenwald, et al "Poly(ethylene glycol) Conjugated Drugs and Prodrugs: A Comprehensive Review", *Crit. Revews in Therap. Drug Carrier Sys.*, 17: 101-161 (2000).
Harris, et al "Pegylation: A Novel Process for Modifying Pharmacokinetics", *Clin. Pharmacok.*, 40: 539-551 (2001).
Hay, et al "Amylin receptors: molecular composition and pharmacology", *Biochem. Soc. Transact.*, 32: 865-867 (2004).
Hay, et al "CL/RAMP2 and CL/RAMP3 produce pharmacologically distinct adrenomedullin receptors: a comparison of effects of adrenomedullin$_{22-52}$, CGRP$_{8-37}$ and BIBN4096BS", *Brit. Jnl. of Pharmacol.*, 140: 477-486 (2003).
Herman, et al "Poly(ethylene glycol) with reactive endgroups: I. Modification of proteins", *Jnl. of Bioactive Compatible Polymers*, 10: 145-187 (1995).
Hubbard, et al "Anti-Neutrophil-Elastase Defenses of the Lower Respiratory Tract in α1-Antitrypsin Deficiency Directly Augmented with an Aerosol of α1-Antitrypsin", *Annals of Int. Med.*, 111: 206-212 (1989).
Katafuchi, et al "Structure and biological properties of three calcitonin receptor-stimulating peptides, novel members of the calcitonin gene-related peptide family", *Peptides*, 25: 2039-2045 (2004).
Katayama, et al "Catabolism of Calcitonin Gene-Related Peptide and Substance P By Neutral Endopeptidase", *Peptides*, 12: 563-567 (1991).
Keil, B. "Specificity of Proteolysis", *Springer-Verlag-Berlin-Heidelberg-New York*, p. 335 (1992).
Khachatryan, et al "Targeted Expression of the Neuropeptide Calcitonin Gene-Related Peptide to β Cells Prevents Diabetes in NOD Mice[1]", *Jnl. of Immunol.*, 158: 1409-1416 (1997).
Kocienski, P. J., "Protecting Groups", Table of Contents (1994).
Kraenzlin, et al "Infusion of a novel peptide, calcitonin gene-related peptide (CGRP) in man. Pharmacokinetics and effects on gastric acid secretion and on gastrointestinal hormones" *Reg. Peptides*, 10: 189-197 (1985).
Kuwasako, et al "Characterization of the Human Calcitonin Gene-Related Peptide Receptor Subtypes Associated with Receptor Activity-Modifying Proteins", *Mol. Pharmacol.*, 65: 207-213 (2004).

Kuwasako, et al "Novel calcitonin-(8-32)-sensitive adrenomedullin receptors derived from co-expression of calcitonin receptor with receptor activity-modifying proteins", *Biochem. and Biophys. Rsh. Comm.*, 301: 460-464 (2003).

Kyte, et al "A Simple Method for Displaying the Hydropathic Character of a Protein", *Jnl. Molec. Biol.*, 157: 105-132 (1982).

Lang, et al "Identification of the Key Residue of Calcitonin Gene Related Peptide (CGRP) 27-37 to Obtain Antagonists with Picomolar Affinity at the CGRP Receptor" *Jnl. of Med. Chem.*, 49: 616-624 (2006).

Le Greves, et al "Calcitonin gene-related peptide is metabolized by an endopeptidase hydrolyzing substance P", *Regul. Peptides*, 25: 277-286 (1989).

Leuthäuser, et al "Receptor-activity-modifying protein 1 forms heterodimers with two G-protein-coupled receptors to define ligand recognition", *Biochem. Jnl.*, 351: 347-351 (2000).

Li, et al "CGRP-mediated cardiovascular effect of nitroglycerin" *Med. Hypoth.*, 60: 693-698 (2003).

Ling, et al "The pattern and distribution of calcitonin gene-related peptide (CGRP) terminals in the rat dorsal following neonatal peripheral inflammation", *Neuroreport*, 14: 1919-1921 (2003).

Link, et al "Non-canonical amino acids in protein engineering", *Curr. Opin. in Biotech.*, 14: 603-609 (2003).

Lu, et al "Pegylated peptides: III. Solid-phase synthesis with pegylating reagents of varying molecular weight: synthesis of multiply pegylated peptides", *Reactive Polymers*, 22: 221-229 (1994).

Lundy, et al "Neuropeptides and Neurogenic Mechanisms in Oral and Periodontal Inflammation", *Crit. Rev. Oral Biol. Med.*, 2: 82-98 (2004).

MacLennan, et al "Structure-Function Relationships in the $Ca^{2+}$-Binding and Translocation Domain of SERCA1: physiological correlates in Brody disease", *Acta Physiol. Scand., Suppl.* 643, 163: 55-67 (1998).

Mallee, et al "Receptor Activity-modifying Protein 1 Determines the Species Selectivity of Non-peptide CGRP Receptor Antagonists", *Jnl. of Biol. Chem.*, 277: 14294-14298 (2002).

Marshall, K., "Solid Oral Dosage Forms", *Mod. Pharmaceut.*, Ch. 10: 359-427 (1979).

McLatchie, et al "RAMPS regulate the transport and ligand specificity of the calcitonin-receptor-like receptor", *Nature*, 393: 333-339 (1998).

Means, et al, "Selected techniques for the modification of protein side chains, in: Chemical modification of proteins", *Holden Day, Inc.*, 219-220 (1971).

Mehvar, R., "Modulation of the Pharmacokinetics and Pharmacodynamics of Proteins by Polyethylene Glycol Conjugation", *Jnl. Pharm. Pharmaceut. Sci.*, 3: 125-136 (2000).

Merrifield "Solid Phase Peptide Synthesis. I. The Synthesis of a Tetrapeptide[1]", *Contribution from the Rockefeller Institute, N.Y.*, 85: 2149-2154 (1963).

Merrifield "Solid Phase Peptide Synthesis", *Rockefeller University, N.Y.*, Ch. 16: 335-361 (1973).

Mimeault, et al "Comparative Affinities and Antagonistic Potencies of Various Human Calcitonin Gene-Related Peptide Fragments on Calcitonin Gene-Related Receptors in Brain and Periphery[1]", *Jnl. of Pharm. and Experim. Therap.*, 258: 1084-1090 (1991).

Morpurgo, et al "Preparation and Characterization of Poly(ethylene glycol) Vinyl Sulfone", *Bioconj. Chem.*, 7: 363-368 (1996).

Muff, et al "Adrenomedullin Selectivity of Calcitonin-like Receptor/Receptor Activity Modifying Proteins", *Hypertens. Res.*, 26: Suppl., S3-S8 (2003).

Muff, et al "An Amylin Receptor is Revealed following Co-transfection of a Calcitonin Receptor with Receptor Activity Modifying Proteins-1 or -3", *Endocrin.*, 140: 2924-2927 (1999).

Muff, et al "Calcitonin, calcitonin gene-related peptide, adrenomedullin and amylin: homologous peptides, separate receptors and overlapping biological actions", *Eur. Jnl. of Endocrin.*, 133: 17-20 (1995).

Nakamura, et al "Osteoclast-like cells express receptor activity modifying protein 2: application of laser capture microdissection", *Jnl. of Mol. Endocrin.*, 34: 257-261 (2005).

Newmark, et al "Short Communication: Preparation and Properties of Adducts of Streptokinase and Streptokinase-Plasmin Complex with Polyethylene Glycol and Pluronic Polyol F38", *Jnl. of Applied Biochem.*, 4: 185-189 (1982).

Oeswein, et al "Aerosolization of Protein Pharmaceuticals", *Proc. Symp. Resp. Drug Deliv. II, Keystone, CO*, Table of Contents; 16-34; Figs. 1-14 (1990).

Ohtori, et al "Phenotypic Inflammation Switch in Rats Shown by Calcitonin Gene-Related Peptide Immunoreactive Dorsal Root Ganglion Neurons Innervating the Lumbar Facet Joints", *Spine*, 26: 1009-1013 (2001).

Olesen, et al "Calcitonin Gene-Related Peptide Receptor Antagonist BIBN 4096 BS for the Acute Treatment of Migraine", *N. E. Jnl. Med.*, 350: 1104-10 (2004).

Poyner, D. R., "Calcitonin Gene-Related Peptide: Multiple Actions, Multiple Receptors", *Pharmac. Ther.*, 56: 23-51 (1992).

Poyner, et al "International Union of Pharmacology. XXXII. The Mammalian Calcitonin Gene-Related Peptides, Adrenomedullin, Amylin, and Calcitonin Receptors", *Pharmacol. Rev.*, 54: 233-246 (2002).

Qin, et al "Temporal and spatial distribution of substance P and its receptor regulated by calcitonin gene-related peptide in the development of airway hyper-responsiveness", *FEBS Jnl.*, $30^{th}$ FEBS Congress & $9^{th}$ IUMB Conf. Website, Abs. No. M3-020P (2005).

Rist, et al "From Micromolar to Nanomolar Affinity: A Systematic Approach to Identify the Binding Site of CGRP at the Human Calcitonin Gene-Related Peptide 1 Receptor", *Jnl. Med. Chem.*, 41: 117-123 (1998).

Rorabaugh, et al "Functional Calcitonin Gene-Related Peptide Subtype 2 Receptors in Porcine Coronary Arteries Are Identified as Calcitonin Gene-Related Peptide Sybtype 1 Receptors by Radioligand Binding and Reverse Transcription-Polymerase Chain Reaction", *Jnl. of Pharmacol. and Experim. Therap.*, 299: 1086-1094 (2001).

Rovero, et al "CGRP Antagonist Activity of Shert C-Terminal Fragments of Human αCGRP, CGRP (23-37) and CGRP (19-37)", *Peptides*, 13: 1025-1027 (1992).

Rudnic, et al "Oral Solid Dosage Forms", *Remington's Pharmac. Sci.*, $18^{th}$ ed., Ch. 89: 1633-1665 (1990).

Sandler, et al "Polyoxyalkylation of Hydroxy Compounds", *Polymer Syntheses*, vol. III, Ch. 5: 138-161 (1980).

Sarchielli, P., et al "Chemokine levels in the jugular venous blood of migraine without aura patients during attacks", *Headache*, 44: 961-968 (2004).

Sasaki, et al "Structure-Mutation Analysis of the ATPase Site of *Dictyostelium Discoideum* Myosin II", *Adv. Biophys.*, 35: 1-24 (1998).

Scadding, J. "Neuropathic Pain", *ACNR Rev. Art.*, 3: 8-15 (2003).

Schechter, et al "On the Active Site of Proteases. III. Mapping the Active Site of Papain; Specific Peptide Inhibitors of Papain", *Biochem. & Biophys. Rsh. Commun.*, 32: 898-902 (1968).

Schechter, et al "On the Size of the Active Site in Proteases. I. Papain", *Biochem. & Biophys. Rsh. Commun.*, 27: 157-162 (1967).

Sexton, et al "Receptor activity modifying proteins", *Cell. Signal.*, 13: 73-83 (2001).

Sjodin, et al "Radioreceptor assay for formulations of salmon calcitonin", *Int. Jnl. of Pharmac.*, 63: 135-142 (1990).

Smith, et al "Modifications to the N-Terminus but Not the C-Terminus of Calcitonin Gene-Related Peptide(8-37) Produce Antagonists with Increased Affinity", *Jnl. Med. Chem.*, 46: 2427-2435 (2003).

Smith, et al "Pulmonary Deposition and Clearance of Aerosolized Alpha-1 Proteinase Inhibitor Administered to Dogs and to Sheep", *Jnl. Clin. Invest.*, 84: 1145-1154 (1989).

SpecChem online News Article ID: 7430, Mar. 25, 2004, The case for PEG conjugation, specchemonline.com., 7 pgs (2004).

Tam, et al "Degradation of Airway Neuropeptides by Human Lung Tryptase", *Am. Jnl. of Respir. Cell and Molec. Biol.*, 3: 27-21 (1990).

Thakor, et al "Role of Nitric Oxide in Mediating In Vivo Vascular Responses to Calcitonin Gene-Related Peptide in Essential and Peripheral Circulations in the Fetus", *Circulation*, 112: 2510-2516 (2005).

Tilakaratne, et al "Amylin Receptor Phenotypes Derived from Human Receptor/RAMP Coexpression Exhibit Pharmacological Differences Dependent on Receptor Isoform and Host Cell Environment[1]", *Jnl. Pharmacol. Exp. Ther.*, 294: 61-72 (2000).

Turk, et al "Determination of protease cleavage site motifs using mixture-based oriented peptide libraries", *Nat. Pub. Grp.*, 19: 661-667 (2001).

Van Rossum, et al "Binding Profile of a Selective Calcitonin Gene-Related Peptide (CGRP) Receptor Antagonist Ligand, [$^{125}$I-Tyr]hCGRP$_{8-37}$, in Rat Brain and Peripheral Tissues[1]", *Jnl. of Pharmacol. and Experim. Therap.*, 269: 846-853 (1994).

Van Rossum, et al "Neuroanatomical Localization, Pharmacological Characterization and Functions of CGRP, Related Peptides and Their Receptors", *Neurosci. Biobehav. Rev.*, 21: 649-678 (1997).

Vater, et al "Short bioactive Spiegelmers to migraine-associated calcitonin gene-related peptide rapipdly identified by a novel approach: Tailored-SELEX", *Nuc. Acids Rsh.*, 31: 1-7 (2003).

Wang, et al "Animal and cellular models of chronic pain", *Adv. Drug Deliv. Rev.*, 55: 949-965 (2003).

Wang, et al "Discovery of Adrenomedullin in Rat Ischemic Cortex and Evidence for its Role in Exacerbating Focal Brain Ischemic Damage", *Proc. Natl. Acad. Sci.*, 92: 11480-11484 (1995).

Waugh, et al "Limitations in Using Peptide Drugs to Characterize Calcitonin Gene-Related Peptide Receptors[1]", *Jnl. of Pharmacol. and Experim. Therap.*, 289: 1419-1426 (1999).

Wimalawansa, et al "Amylin, Calcitonin Gene-Related Peptide, Calcitonin, and Adrenomedullin: A Peptide Superfamily", *Crit. Revs. in Neurobiol.*, 11: 167-239 (1997).

Zalipsky, S., "Chemistry of polyethylene glycol conjugates with biologically active molecules", *Adv. Drug Deliv. Revs.*, 16: 157-182 (1995).

Zalipsky, et al "21. Use of Functionalized Poly(Ethylene Glycol)s for Modification of Polypeptides", *Poly(Ethylene Glycol) Chemistry: Biotechnical and Biomedical Applications, Plenum Press*, 347-370 (1992).

Zimmerman, et al "Research report: Identification of adrenomedullin receptors in cultured rat astrocytes and in neuroblastboma X glioma hybrid cells (NG108-15)", *Brain Rsh.*, 724; 238-245 (1996).

Structure of human αCGRP

Shaded residues have been implicated in receptor binding.

| 1-7 | 8-18 | 19-27 | 28-37 |
|---|---|---|---|
| receptor activation | receptor binding | hinge region | receptor binding |
| ACDTATC | VTHRLAGLLSR | SGGVVKNNFV | PTNVGSKAF CONH$_2$ |
| disulfide | α-helix | turn | turn  turn |

CGRP PEPTIDE ANTAGONISTS AND CONJUGATES

This application claims the benefit of U.S. Provisional Application No. 60/729,083, filed Oct. 21, 2005, which is hereby incorporated by reference.

The instant application contains an ASCII "txt" compliant sequence listing submitted via EFS-WEB on Oct. 7, 2010, which serves as both the computer readable form (CRF) and the paper copy required by 37 C.F.R. Section 1.821(c) and 1.821(e). The name of the "txt" file created on Oct. 5, 2010, is: A-1061-US-NPRev100610_ST25.txt, and is 743 kb in size.

This application incorporates by reference all subject matter contained on the compact disc, which is identified by the name of the file, A-1061 US.042707.ST25.txt created on Apr. 27, 2007, the size of which file is 743 KB.

Throughout this application various publications are referenced within parentheses. The disclosures of these publications in their entireties are hereby incorporated by reference in this application in order to more fully describe the state of the art to which this invention pertains.

BACKGROUND OF THE INVENTION

1. Field of the Invention

The present invention is related to the biochemical arts, in particular to therapeutic peptide conjugates.

2. Discussion of the Related Art

The calcitonin (CT) superfamily of peptides includes at least five known members: CT, amylin (AMY), adrenomedullin (ADM), and two calcitonin gene-related peptides, CGRP1 (also known as αCGRP) and CGRP2 (also known as βCGRP). Calcitonin is involved in the control of bone metabolism and is also active in the central nervous system (CNS). Amylin also has specific binding sites in the CNS and is thought to regulate gastric emptying and have a role in carbohydrate metabolism. ADM is a potent vasodilator. ADM has specific receptors on astrocytes and its messenger RNA is upregulated in CNS tissues that are subject to ischaemia. (Zimmermann, et al., Identification of adrenoinedullin receptors in cultured rat astrocytes and in neuroblastoina glioma hybrid cells (NG108-15), Brain Res., 724:238-245 (1996); Wang et al., Discovery of adrenoinedullin in rat ischaemic cortex and evidence for its role in exacerbating focal brain ischaemic damage, Proc. Natl. Acad. Sci. USA, 92:11480-11484 (1995)). The biological activities of CGRP include the regulation of neuromuscular junctions, of antigen presentation within the immune system, of vascular tone and of sensory neurotransinission. (Poyner, D. R., Calcitonin gene-related peptide: multiple actions, multiple receptors, Pharmacol. Ther., 56:23-51 (1992); Muff et al., Calcitonin, calcitonin gene related peptide, adrenomedullin and amylin: homologous peptides, separate receptors and overlapping biological actions, Eur. J. Endocrinol., 133: 17-20 (1995)). Three calcitonin receptor stimulating peptides (CRSPs) have also recently been identified in a number of mammalian species; the CRSPs may form a new subfamily in the CGRP family, however, the endogenous molecular forms, receptors, and biological activity of the CRSPs remain unidentified. (Katafuchi, T and Minamino, N, Structure and biological properties of three calcitonin receptor-stimulating peptides, novel members of the calcitonin gene-related peptide family, Peptides, 25(11):2039-2045 (2004)).

The CT superfamily peptides act through seven-transmembrane-domain G-protein-coupled receptors (GPCRs). The CT receptor and CGRP receptors are type II ("family B") GPCRs, which family includes other GPCRs that recognize regulatory peptides such as secretin, glucagon and vasoactive intestinal polypeptide (VIP). The best characterized splice variants of human CT receptor differ depending on the presence (formerly $CTR_{II+}$ or CTR1, now known as $CT_{(b)}$) or absence (the major splice variant, formerly $CTR_{II-}$ or CTR2, now known as $CT_{(a)}$) of 16 amino acids in the first intracellular loop. (Gorn et al., Expression of two human skeletal calcitonin receptor isoforms cloned from a giant cell tumor of bone: the first intracellular domain modulates ligand binding and signal transduction, J. Clin. Invest., 95:2680-2691 (1995); Hay et al., Amylin receptors: molecular composition and pharmacology, Biochem. Soc. Trans., 32:865-867 (2004); Poyner et al., 2002). The existence of at least two CGRP receptor subtypes had been proposed from differential antagonist affinities and agonist potencies in a variety of in vivo and in vitro bioassays. (Dennis et al., CGRP8-37, A calcitonin gene-related peptide antagonist revealing calcitonin gene-related peptide receptor heterogeneity in brain and periphery, J. Pharmacol. Exp. Ther., 254:123-128 (1990); Dennis et al., Structure-activity profile of calcitonin gene-related peptide in peripheral and brain tissues. Evidence for receptor multiplicity, J. Pharmacol. Exp. Ther., 251:718-725 (1989); Dumont et al., A potent and selective CGRP2 agonist, [Cys(Et)2,7]hCGRP: comparison in prototypical CGRP1 and CGRP2 in vitro assays, Can. J. Physiol. Pharmacol., 75:671-676 (1997)).

The $CGRP_1$ receptor subtype was found to be sensitive to the antagonist fragment CGRP(8-37). (Chiba et al., Calcitonin gene-related peptide receptor antagonist human CGRP-(8-37), Am. J. Physiol., 256:E331-E335 (1989); Dennis et al. (1990); Mimeault et al., Comparative affinities and antagonistic potencies of various human calcitonin gene-related peptide fragments on calcitonin gene-related peptide receptors in brain and periphery, J. Pharmacol. Exp. Ther., 258: 1084-1090 (1991)). By contrast, the $CGRP_2$ receptor was sensitive to linear human CGRP (hCGRP) analogs, in which the cysteine residues at positions 2 and 7 were derivatized (e.g., with acetoaminomethyl $[Cys(ACM)^{2,7}]$ or ethylamide $[Cys(Et)^{2,7}]$) but $CGRP_2$ receptor was insensitive to fragment CGRP(8-37). (Dennis et al. (1989); Dennis et al. (1990); Dumont et al. (1997)). In 1998, the $CGRP_1$ receptor was identified as a heterodimer composed of a novel single transmembrane domain accessory protein, receptor activity-modifying protein 1 (RAMP1), and calcitonin receptor-like receptor (CRLR or "CL"). (McLatchie et al., RAMPs regulate the transport and ligand specificity of the calcitonin-receptor-like receptor, Nature, 393:333-339 (1998)).

CRLR has 55% overall amino acid sequence identity with CT receptor, although the transmembrane domains are almost 80% identical. (McLatchie et al. (1998); Poyner et al., International union of pharmacology. XXXII. The mammalian calcitonin gene-related peptides, adrenomedullin, amylin and calcitonin receptors, Pharmacol. Rev., 54:233-246 (2002)).

Ligand specificity of CT receptor and CRLR depend on the coexpression of members of a family of accessory proteins called the receptor activity modifying proteins (RAMPs). The RAMP family includes three that act as receptor modulators that determine the ligand specificity of receptors for the CT family members. RAMPs are type I transmembrane proteins that share about 30% amino acid sequence identity and a common predicted topology, with short cytoplasmic C-termini, one trans-membrane domain and large extracellular N-termini that are responsible for the specificity. (McLatchie et al. (1998); Fraser et al., The amino terminus of receptor activity modifying proteins is a critical determinant of glycosylation state and ligand binding of calcitonin receptor-like receptor, Molecular Pharmacology, 55:1054-1059 (1999)).

CRLR has been shown to form a high affinity receptor for CGRP, when associated with RAMP1, or, to preferentially bind ADM when associated with RAMP2 or RAMP3. (McLatchie et al. (1998); Sexton et al., Receptor activity modifying proteins, Cellular Signaling, 13:73-83 (2001); Conner et al., Interaction of calcitonin-gene-related peptide with its receptors, Biochemical Society Transactions 30(Part 4): 451-454 (2002)). The glycosylation state of CRLR is associated with its pharmacology. RAMPs 1, 2, and 3 transport CRLR to the plasma membrane with similar efficiencies, however RAMP1 presents CRLR as a terminally glycosylated, mature glycoprotein and a CGRP receptor, whereas RAMPs 2 and 3 present CRLR as an immature, core glycosylated ADM receptor. (Fraser et al. (1999)). Characterization of the CRLR/RAMP2 and CRLR/RAMP3 receptors in HEK293T cells by radioligand binding ($^{125}$I-ADM as radioligand), functional assay (cAMP measurement), or biochemical analysis (SDS-polyacrylamide gel electrophoresis) revealed them to be indistinguishable, even though RAMPs 2 and 3 share only 30% amino acid sequence identity. (Fraser et al. 1999)). Differences have been observed, however, in the pharmacology for CRLR expressed with RAMP 2 versus RAMP 3. Both αCGRP and CGRP8-37 as well as ADM and ADM 22-52 are active at the RAMP 3 heterodimer, indicating that this complex may act as both a CGRP and an ADM receptor. (Howitt et al., British Journal of Pharmacology, 140:477-486 (2003); Muff et al., Hypertens. Res., 26:S3-S8 (2003)). Coexpression of human CRLR with rat RAMP1, and vice versa, showed that the RAMP1 species determined the pharmacological characteristics of the CRLR/RAMP1 complex with respect to several small molecule CGRP receptor antagonists tested. (Mallee et al., Receptor Activity-Modifying Protein 1 determines the species selectivity of non-peptide CGRP receptor antagonists, J. Biol. Chem., 277(16): 14294-14298 (2002)). Unless associated with a RAMP, CRLR is not known to bind any endogenous ligand; it is currently the only GPCR thought to behave this way. (Conner et al., A key role for transmembrane prolines in calcitonin receptor-like agonist binding and signaling: implications for family B G-protein-coupled receptors, Molec. Pharmacol., 67(1):20-31 (2005)).

CT receptor has also been demonstrated to form heterodimeric complexes with RAMPs, which are known as amylin receptors. Generally, CT/RAMP1 (AMY$_1$) receptors have high affinity for salmon CT, AMY and CGRP and lower affinity for mammalian CTs. For CT/RAMP2 (AMY$_2$) receptors and CT/RAMP3 (AMY$_3$) receptors, a similar pattern is principally observed, although the affinity for CGRP is lower and may not be significant at physiologically relevant ligand concentrations. The precise receptor phenotype is dependent on cell type and CT receptor splice variant (CT$_{(a)}$ or CT$_{(b)}$), particularly for RAMP2-generated AMY receptors. For example, a pure population of osteoclast-like cells reportedly expressed RAMP2, CT receptor, and CRLR, but not RAMP1 or RAMP3. (Hay et al. (2004); Christopoulos et al., Multiple amylin receptors arise from receptor activity-modifying protein interaction with the calcitonin receptor gene product, Molecular Pharmacology, 56:235-242 (1999); Muff et al., An amylin receptor is revealed following co-transfection of a calcitonin receptor with receptor activity modifying proteins-1 or -3, Endocrinology, 140:2924-2927 (1999); Sexton et al. (2001); Leuthäuser et al., Receptor-activity-modifying protein 1 forms heterodimers with two G-protein-coupled receptors to define ligand recognition, Biochem. J., 351:347-351 (2000); Tilakaratne et al., Amylin receptor phenotypes derived from human calcitonin receptor/RAMP coexpression exhibit pharmacological differences dependent on receptor isoform and host cell environment, J. Pharmacol. Exp. Ther., 294:61-72 (2000); Nakamura et al., Osteoclast-like cells express receptor activity modifying protein 2: application of laser capture microdissection, J. Molec. Endocrinol., 34:257-261 (2005)).

The CGRP-sensitive responses mediated via CT/RAMPs are blocked by the selective receptor antagonist calcitonin(8-32) but not by CGRP(8-37), which antagonizes the CRLR/RAMP1 complex (CGRP$_1$ receptor). (Kuwasako et al., Novel calcitonin-(8-32)-sensitive adrenomedullin receptors derived from co-expression of calcitonin receptor with receptor activity-modifying proteins, Biochem. Biophys. Res. Commun., 301:460-464 (2003); Leuthäuser et al., 2000).

The αCGRP peptide (also known as CGRP1) and (βCGRP peptide (also known as CGRP2) are 37 amino acid residues long and differ from each other by three amino acids. These two isoforms have so far proved to be indistinguishable in their biological activities. (Poyner, D. R. (1992); Muff et al. (1995)). Native human αCGRP and βCGRP each contain a disulfide bridge between cysteine residues at amino acid positions 2 and 7 and a carboxy-terminal phenylalanine amide, both of which are required for biological activity of the native peptides. (Wimalawansa, S J, Amylin, calcitonin gene-related peptide, calcitonin and adrenomedullin: a peptide superfamily, Crit. Rev. Neurobiol., 11: 167-239 (1997)). Their binding sites are widely distributed among peripheral tissues and in the central nervous system, enabling CGRP to exert a wide variety of biological effects, including potent vasodilation. (Van Rossum et al., Neuroanatomical localization, pharmacological characterization and functions of CGRP, related peptides and their receptors, Neurosci. Biobehav. Rev., 21:649-678 (1997)).

Structural studies investigating the interaction of CGRP with its receptor have defined both functional sub-domains and specific residues involved in receptor binding and activation. (Conner, A. C., Biochem. Soc. Trans., 30:451-455 (2002)). As illustrated in FIG. 1, the first seven amino acid residues of CGRP, which form a disulphide-bonded loop, are thought to interact with the transmembrane domain of CRLR to cause receptor activation. CGRP(8-37) fragment binds with high affinity to CGRP$_1$ receptor, but acts as an antagonist. The rest of the CGRP molecule falls into three domains or regions: amino acid residues 28-37 and 8-18 are normally required for high-affinity binding with the CGRP$_1$ receptor, while residues 19-27 form a hinge region, which appears to allow a hairpin-like structure wherein the two sub domains interact with one another at the receptor interface. The 28-37 region is thought to be in direct contact with the receptor during binding, while the α-helical region comprising residues 8-18 may make additional receptor contacts or may stabilize an appropriate conformation of the 28-37 region. It is likely that these binding regions of CGRP interact with CGRP$_1$ receptor both at the CRLR and at the extracellular domain of RAMP1. The amidated carboxy-terminal residue has been shown to be essential for high affinity binding to CGRP$_1$ receptors by CGRP and CGRP peptide analogs. Mutation analyses have further implicated select residues R11, R18, T30, V32 S34 and F37 in receptor binding. (Rist et al., From micromolar to nanomolar affinity: a systematic approach to identify the binding site of CGRP at the human calcitonin gene-related peptide 1 receptor, J. Med. Chem., 41:117-123 (1998); Conner et al., Interaction of calcitonin-gene-related peptide with its receptors, Biochem. Soc. Trans., 30(4):451-455 (2002); Smith et al., Modifications to the N-terminus but not the C-terminus of calcitonin gene-related peptide(8-37) produce antagonists with increased affinity, J. Med. Chem., 46:2427-2435 (2003)).

Moreover, amino-terminal truncations of CGRP (e.g., CGRP(8-37)) have been identified that are antagonistic to the receptor. While further truncations (e.g., CGRP(28-37)) show very little receptor binding, much of the lost antagonist activity can be restored with three point mutations (T30D, V32P and G33F) in the CGRP(28-37) region. (Rist, B. et al., J. Med. Chem., 41:117-123 (1998)). It has been suggested that these amino acid substitutions compensate for the missing (CGRP (8-27) domain (Carpenter, K. A. et al., Turn structures in CGRP C-terminal analogues promote stable arrangements of key residue side chains, Biochemistry, 40:8317-8325 (2001)).

CGRP is thought to have a causative role in migraine. Migraine pathophysiology involves the activation of the trigeminal ganglia, where CGRP is localized, and CGRP levels significantly increase during a migraine attack. This in turn, promotes cranial blood vessel dilation and neurogenic inflammation and sensitization. (Doods, H., Curr. Opin. Investig. Drugs, 2:1261-1268 (2001)). CGRP has been shown to induce migraine headaches in patients susceptible to migraines. Furthermore, in a recent Phase II clinical trial, a potent small-molecule CGRP antagonist has been shown to alleviate migraine pain. CGRP may also be involved in chronic pain syndromes other than migraine. In rodents, intrathecally delivered CGRP induces severe pain, and CGRP levels are enhanced in a number of pain models. In addition, CGRP antagonists block neuropathic and capsaicin-induced pain in rodents. Together, these observations imply that a potent and selective CGRP receptor antagonist can be an effective therapeutic for treatment of chronic pain, including migraine.

CGRP has also been implicated in diabetes mellitus (type II), inflammation, cardiovascular disorders, and in the hemodynamic derangements associated with endotoxemia and sepsis resulting from postoperative infection and a variety of other infectious diseases. (E.g., Khachatryan, A et al., Targeted expression of the neuropeptide calcitonin gene-related peptide to beta cells prevents diabetes in NOD mice, J. Immunol., 158(3):1409-1416 (1997); Ohtori S et al., Phenotypic inflammation switch in rats shown by calcitonin gene-related peptide immunoreactive dorsal root ganglion neurons innervating the lumbar facet joints, Spine, 26(9):1009-1013 (2001); Qin, X et al. Temporal and spatial distribution of Substance P and its receptor regulated by calcitonin gene-related peptide in the development of airway hyperresponsiveness, FEBS Journal, 30$^{th}$ FEBS Congress & 9$^{th}$ IUMB Conference Website, Abstract No. M3-020P (2005); Brain, S D et al., Evidence that calcitonin gene-related peptide contributes to inflammation in the skin and joint, Ann. NY Acad. Sci., 657(1):412-419 (1992); Caviedes-Bucheli, J. et al., Expression of calcitonin gene-related peptide(CGRP) in irreversible acute pulpitis, J. Endodontics, 30(4):201-204 (2004); Ling, Q D et al., The pattern and distribution of calcitonin gene-related peptide (CGRP) terminals in the rat dorsal following neonatal peripheral inflammation, Neuroreport, 14(15):1919-1921 (2003); Li, Y J et al., CGRP-mediated cardiovascular effect of nitroglycerin, Med Hypotheses, 60(5):693-698 (2003); Beer, S et al., Systemic neuropeptide levels as predictive indicators for lethal outcome in patients with postoperative sepsis, Critical Care Medicine, 30(8): 1794-1798 (2002)).

Therapeutic administration of CGRP analogs was taught by Evans et al. for the lowering of blood pressure and gastric acid secretion, and for other effects on, for example, ingestion behavior, taste and sensory perception, e.g., nociception. (U.S. Pat. No. 4,530,838; U.S. Pat. No. 4,736,023).

Therapeutic use of CGRP antagonists and CGRP-targeting aptamers has been proposed for the treatment of migraine and other disorders. (E.g., Olesen et al., Calcitonin gene-related peptide receptor antagonist BIBN 4096 BS for the acute treatment of migraine, New Engl. J. Med., 350:1104-1110 (2004); Perspective: CGRP-receptor antagonists—a fresh approach to migraine, New Engl. J. Med., 350:1075 (2004); Vater et al., Short bioactive Spiegelmers to migraine-associated calitonin gene-related peptide rapidly identified by a novel approach: tailored-SELEX, Nuc. Acids Res., 31(21 e130):1-7 (2003); WO 96/03993).

For example, Noda et al. described the use of CGRP or CGRP derivatives for inhibiting platelet aggregation and for the treatment or prevention of arteriosclerosis or thrombosis. (EP 0385712 B1).

Liu et al. disclosed therapeutic agents that modulate the activity of CT receptor, including vehicle-conjugated peptides such as calcitonin and human αCGRP. (WO 01/83526 A2; US 2002/0090646 A1).

Vasoactive CGRP peptide antagonists and their use in a method for inhibiting CGRP binding to CGRP receptors were disclosed by Smith et al.; such CGRP peptide antagonists were shown to inhibit CGRP binding to coronary artery membranes and to relax capsaicin-treated pig coronary arteries. (U.S. Pat. No. 6,268,474 B1; and U.S. Pat. No. 6,756,205 B2).

Rist et al. disclosed peptide analogs with CGRP receptor antagonist activity and their use in a drug for treatment and prophylaxis of a variety of disorders. (DE 19732944 A1).

Nevertheless, CGRP peptides have shown a number of problems as therapeutics. Native CGRP peptides are typically nonselective, inactive in oral form, generally have a short duration of action and can elicit a number of potential side effects that can include undesirable effects on blood pressure. In general, therapeutic peptides and proteins exhibit very fast plasma clearance, thus requiring frequent injections to ensure steady pharmaceutically relevant blood levels of a particular peptide or protein with pharmacological activity. Many pharmaceutically relevant peptides and proteins, even those having human primary structure, can be immunogenic, giving rise to neutralizing antibodies circulating in the bloodstream. This is especially true for intravenous and subcutaneous administration, which is of particular concern for the delivery of most peptide and protein drugs.

By increasing the molecular volume and by masking potential epitopes, modification of a therapeutic polypeptide with a vehicle, such as a polyethylene glycol (PEG) polymer, has been shown to be effective in reducing both the rate of clearance as well as the antigenicity of the protein. Reduced proteolysis, increased water solubility, reduced renal clearance, and steric hindrance to receptor-mediated clearance are a number of mechanisms by which the attachment of a polymer to the backbone of a polypeptide may prove beneficial in enhancing the pharmacokinetic properties of the drug. For example, Davis et al. taught conjugating PEG or polypropylene glycol to proteins such as enzymes and insulin to produce a less immunogenic product while retaining a substantial proportion of the biological activity. (U.S. Pat. No. 4,179, 337).

In the actual practice of developing a conjugated peptide drug, it is not a trivial matter to overcome the significantly lower potency that a conjugated form typically exhibits relative to the unconjugated form of the peptide. (J. M. Harrist et al., PEGylation: A Novel Process for Modifying Pharmacokinetics, Clin. Pharmacokinet., 40:539-551 (2001); and R. Mehvar, Modulation of the Pharmacokinetics and Pharmacodynamics of Proteins by Polyethylene Glycol Conjugation, J. Pharm. Pharmaceut. Sci., 3:125-136 (2000)).

It is, therefore, a desideratum to combine the therapeutic benefits of vehicle-conjugated CGRP peptides and analogs (particularly, but not limited to, those with CGRP receptor antagonist activity), such as substantially increased pharmacological half-life and decreased immunogenicity, with little, if any, loss of potency relative to unconjugated forms. These and other benefits are provided by the present invention.

SUMMARY OF THE INVENTION

The present invention relates to: compositions of matter involving CGRP peptide antagonists (i.e., CGRP peptides that are $CGRP_1$ receptor antagonists). In some embodiments, these CGRP peptide antagonists are vehicle-conjugated, or alternatively, in other embodiments, they are not conjugated to a vehicle (i.e., "unconjugated" or "free" or "naked" peptides). Some of the vehicle-conjugated CGRP peptide antagonists of the invention include those having a native CGRP peptide sequence. Alternatively, whether in vehicle-conjugated or unconjugated embodiments, the CGRP peptide antagonists of the present invention include CGRP peptide analogs containing modifications relative to a native CGRP sequence of interest, and can contain amino acid residues that are canonical or non-canonical, naturally rare, and/or unnatural. The CGRP peptide can possess either a full length CGRP sequence, or a truncated fragment thereof, as long as it has a first $CGRP_1$ receptor binding region proximal to the carboxy terminal end of the peptide.

The present invention also relates to methods of producing the compositions of matter; to pharmaceutical compositions containing the composition of matter, i.e., the CGRP peptide antagonist and a pharmaceutically acceptable carrier; and to clinical methods involving administration of the CGRP peptide antagonist to a patient.

The compositions of matter and pharmaceutical compositions of the present invention, comprising the CGRP peptide antagonists, can provide substantially increased in vivo pharmacological half-life and/or decreased immunogenicity, compared to corresponding unconjugated forms or unmodified amino acid sequences, while maintaining relatively high potency.

The vehicle-conjugated, or unconjugated, CGRP peptide antagonist, involved in the inventive composition of matter, includes a CGRP peptide that lacks a functional $CGRP_1$ receptor activation region, but includes from its C-terminal end to its N-terminal end:

the C-terminal carboxy moiety is replaced with a moiety selected from:

(A) —C(=O)NRR, where R is independently hydrogen, $(C_1-C_8)$alkyl, haloalkyl, aryl or heteroaryl; and (B) —$CH_2$OR where R is H (e.g., representing a peptide alcohol), or $(C_1-C_8)$alkyl, aryl or heteroaryl (e.g., representing a peptide ester). For example, in (A) the NRR can represent an amide moiety (interchangeably designated "-amide" or "—$NH_2$" or "—$NH_2$" at the C-terminal end of sequences listed herein), N-mono-substituted or N-di-substituted alkyl or aryl amide; and the CGRP peptide includes a first CGRP1 receptor binding region.

In vehicle-conjugated embodiments, a pharmaceutically acceptable vehicle is conjugated to the CGRP peptide at a site on the CGRP peptide other than at its carboxy terminal amino acid residue.

Accordingly, the invention is also related to a method of producing a composition of matter, which involves obtaining a CGRP peptide that lacks a functional $CGRP_1$ receptor activation region, which CGRP peptide includes from its C-terminal end to its N-terminal end: an amide moiety at the C-terminus; and a first CGRP1 receptor binding region. The obtained CGRP peptide is conjugated to a pharmaceutically acceptable vehicle at a site on the obtained peptide other than at the C-terminal amino acid residue.

The present invention is also directed to a method of treating migraine, in which a patient in need of such treatment is administered a therapeutically effective amount of the inventive composition of matter, so that one or more migraine symptoms is alleviated in the patient.

The present invention is also directed to a method of preventing or mitigating migraine, which involves administering to a patient who has previously experienced a migraine a prophylactically effective amount of the inventive composition of matter, so that at least one symptom of a subsequent migraine is prevented or mitigated.

BRIEF DESCRIPTION OF THE FIGURES

FIG. 6 shows the effect of co-solvent on the PEGylation efficiency of a relatively soluble CGRP peptide SEQ. ID NO 7 in the presence of

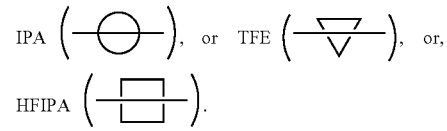

Figure 7:
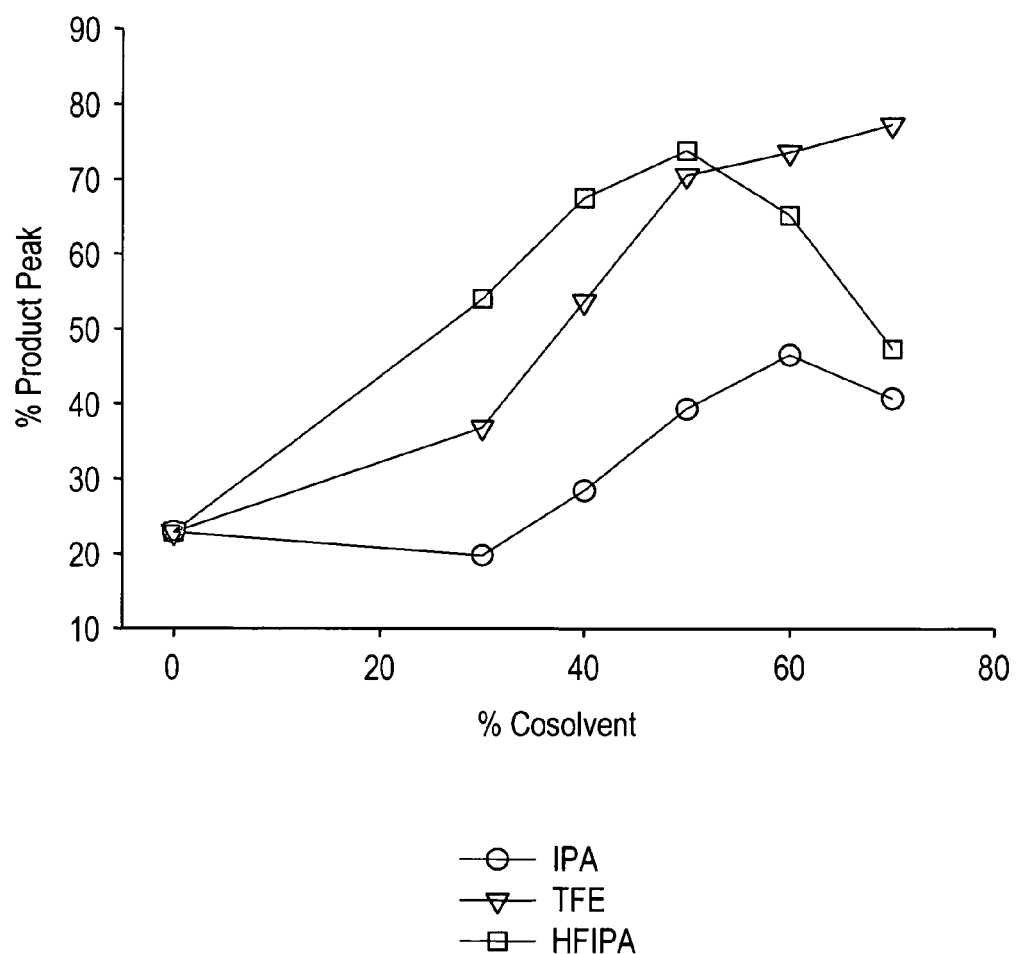

FIG. 7 shows the effect of co-solvent concentration on the PEGylation efficiency of a relatively insoluble CGRP peptide SEQ ID No:739 in the presence of

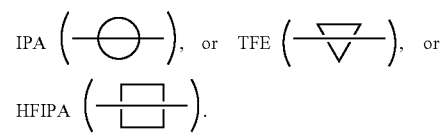

Figure 8:
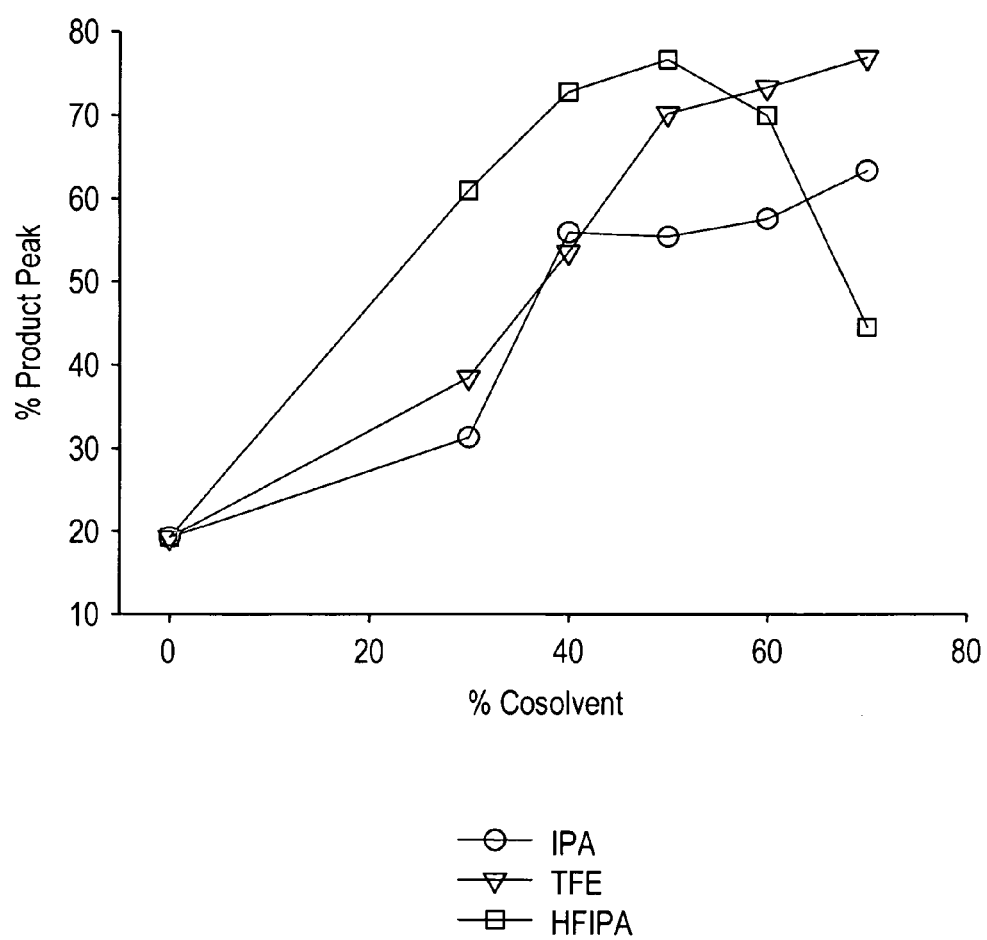

FIG. 8 shows the effect of co-solvent concentration on the PEGylation efficiency of a relatively insoluble CGRP peptide SEQ ID No:658 in the presence of

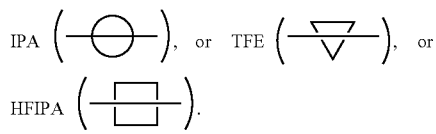

Figure 9:
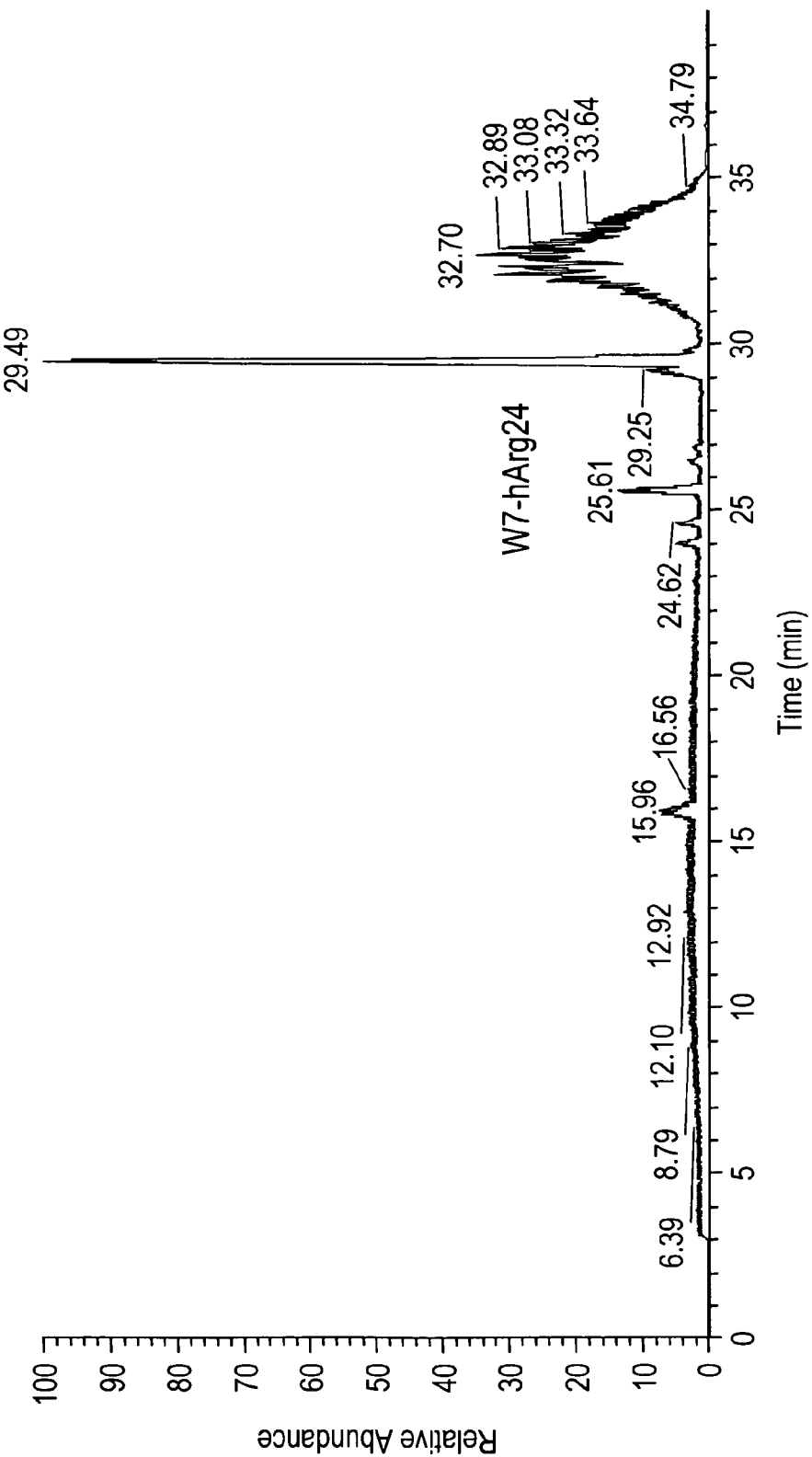

FIG. 9 shows in vitro metabolic identification of Seq ID: No:658 in 100% human plasma after 4 hours incubation at room temperature.

Figure 10:
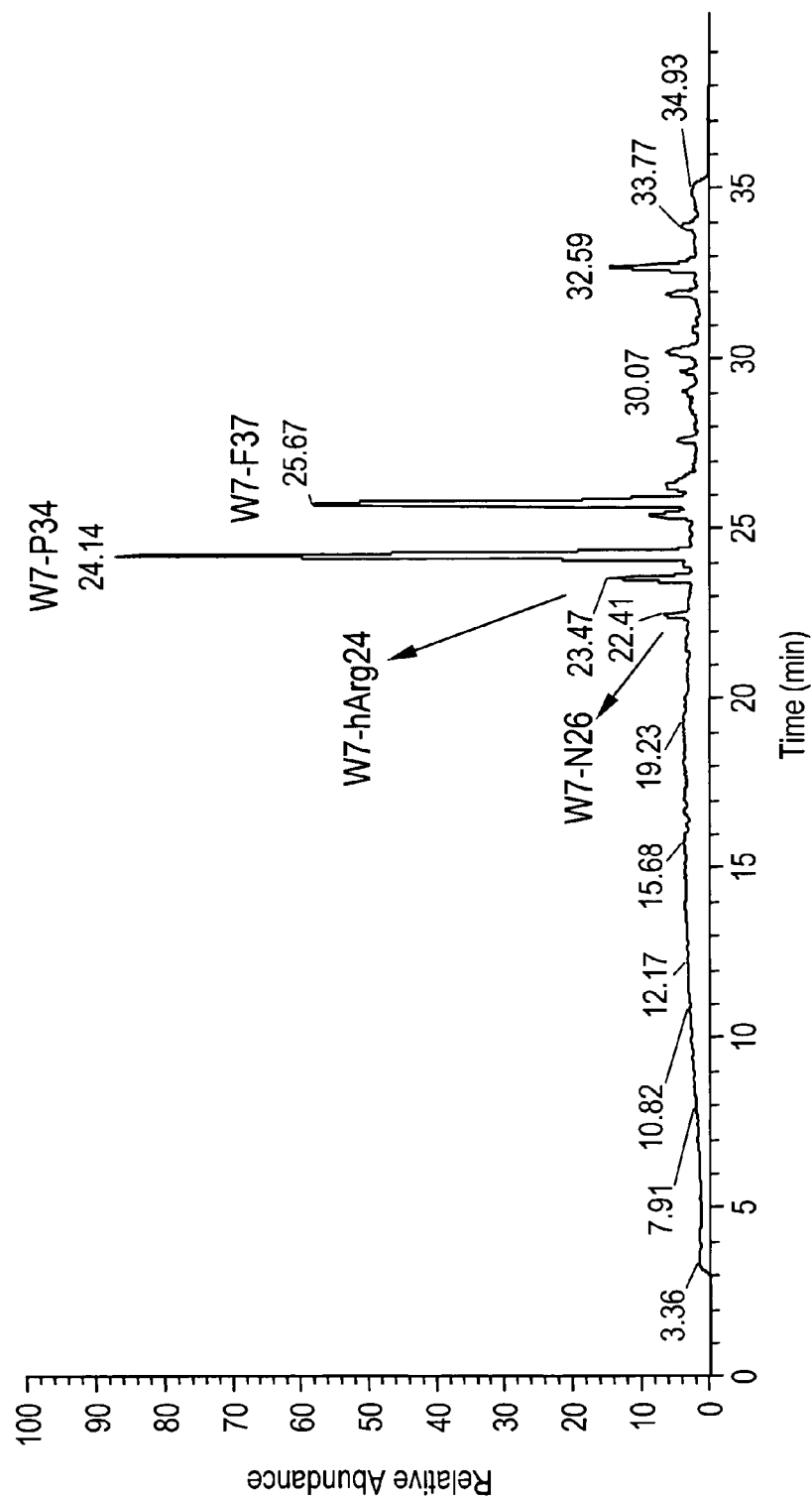

FIG. 10 shows in vitro metabolic identification of the Seq ID: No: 144 in 100% human plasma after 4 hours incubation at room temperature.

Figure 11:
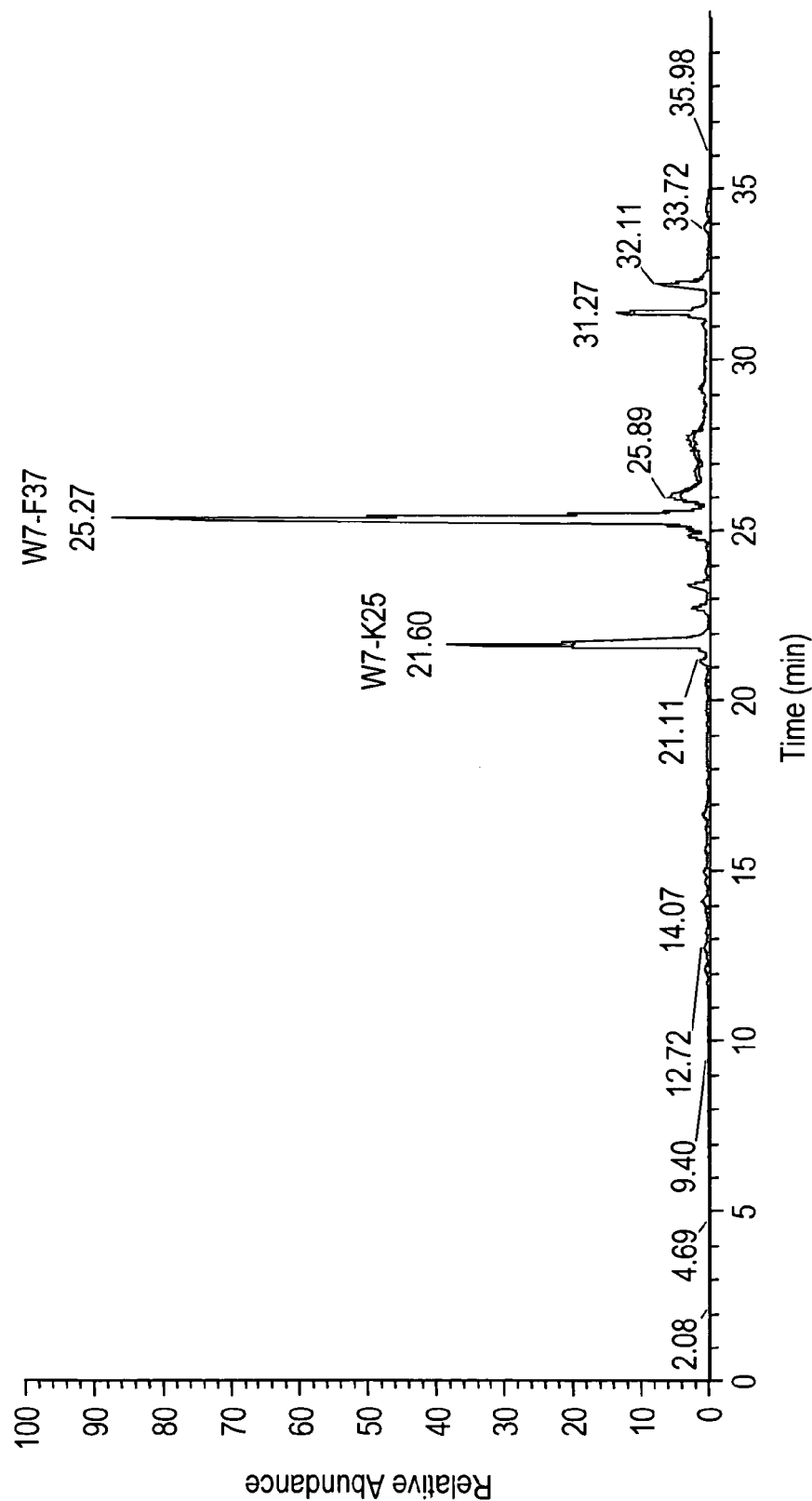

FIG. 11 shows in vitro metabolic identification of Seq ID: No:658 in 100% monkey plasma after 4 hours incubation at room temperature.

Figure 12:
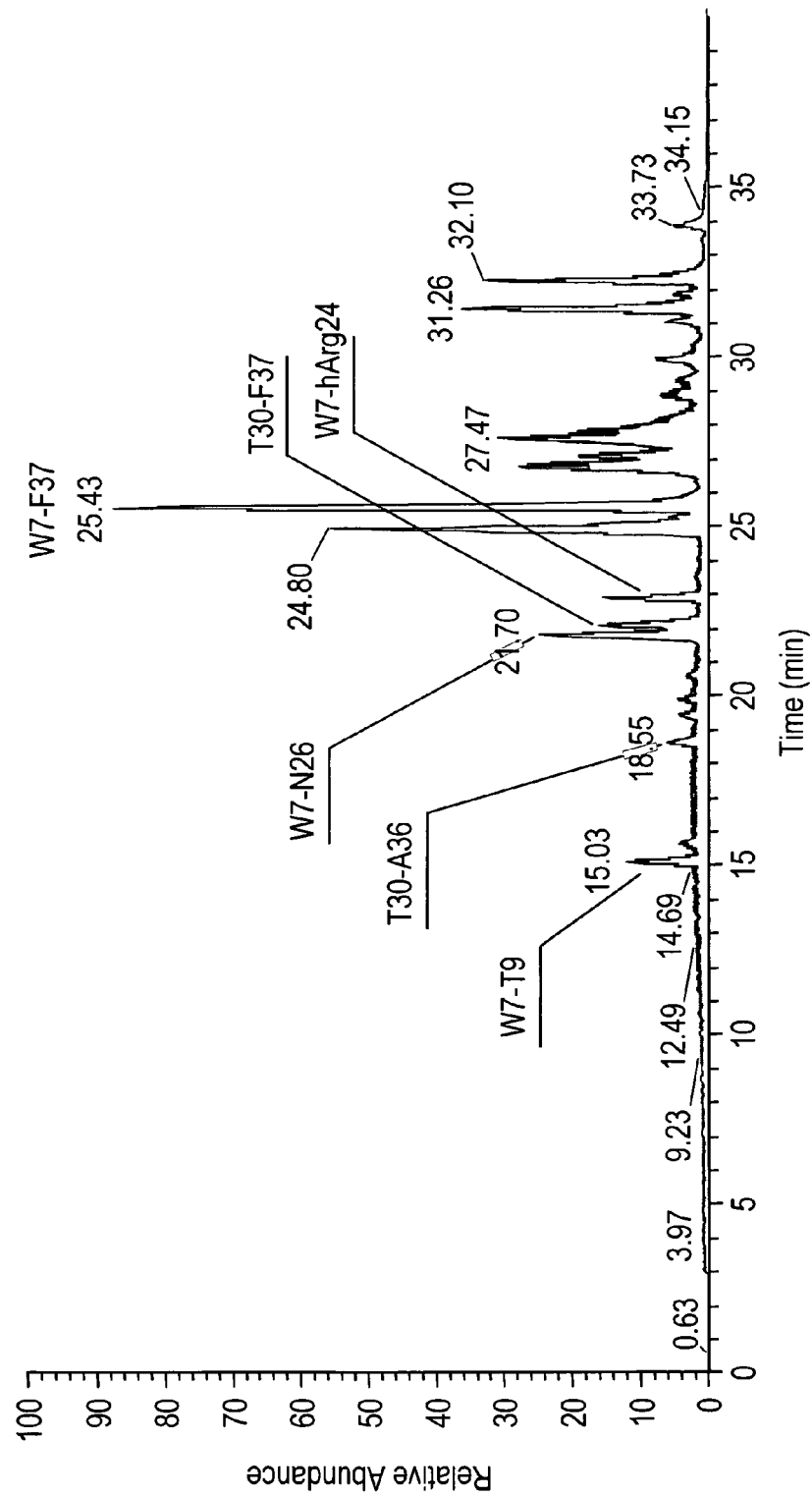

FIG. 12 shows in vivo metabolic identification of Seq ID: No:658 in monkey plasma during 30 minutes of intravenous infusion with dose of 6 mg/kg.

Figure 13:
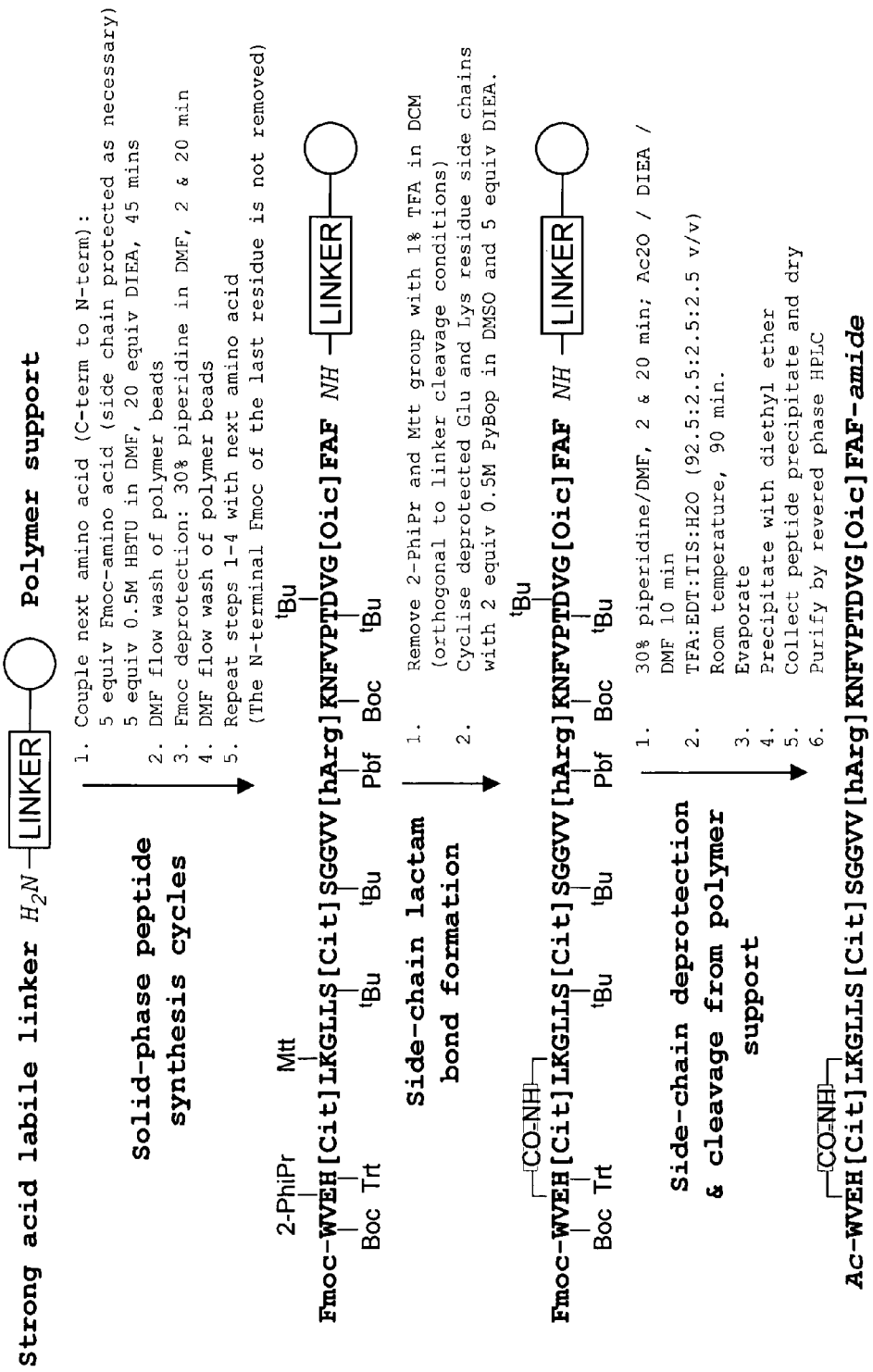

FIG. 13 illustrates some peptide synthesis techniques that can be employed in making CGRP peptides in accordance with the present invention.

DETAILED DESCRIPTION OF THE PREFERRED EMBODIMENTS

The present invention relates to a composition of matter, which involves a vehicle-conjugated CGRP peptide antagonist that preferentially binds to a mammalian $CGRP_1$ receptor and antagonizes its biological activity. Mammalian $CGRP_1$ receptors can include those of humans or other primates, rodents, canines, felines, or any other mammal of interest, or of harvested or cultured mammalian cells.

"Polypeptide" and "protein" are used interchangeably herein and include a molecular chain of amino acids linked through peptide bonds. The terms do not refer to a specific length of the product. Thus, "peptides," and "oligopeptides," are included within the definition of polypeptide. The terms include post-translational modifications of the polypeptide, for example, glycosylations, acetylations, phosphorylations and the like. In addition, protein fragments, analogs, mutated or variant proteins, fusion proteins and the like are included within the meaning of polypeptide. The terms also include molecules in which one or more amino acid analogs or non-canonical or unnatural amino acids are included.

"$CGRP_1$ receptor" means a cell membrane-integrated CRLR/RAMP1 (or "CRLR-RAMP1") complex.

A "CGRP peptide" is a peptide that preferentially binds the $CGRP_1$ receptor under physiological conditions of temperature, pH, and ionic strength. For purposes of the present invention, CGRP peptides include those having a full native CGRP peptide sequence and non-native CGRP peptide analogs containing modifications of a native CGRP sequence (e.g., amino acid substitutions, insertions, deletions, and/or amino terminal end truncations as further described herein below) relative to a native CGRP sequence of interest, which can be, e.g., any known mammalian CGRP sequence, such as but not limited to, the native human αCGRP sequence or human βCGRP sequence. In accordance with the present invention, the CGRP peptide the C-terminal carboxy moiety is replaced with a moiety selected from: (A) —C(=O)NRR, where R is independently hydrogen, $(C_1-C_8)$alkyl, haloalkyl, aryl or heteroaryl; and (B) —$CH_2OR$ where R is H, $(C_1-C_8)$ alkyl, aryl or heteroaryl. In some embodiments, this constitutes a carboxy terminally amidated amino acid sequence, such as, but not limited to, a sequence having a C-terminal phenylalaninamide residue or tyrosineamide residue. (See, e.g., Smith et al., Modifications to the N-terminus but not the C-terminus of calcitonin gene-related peptide(8-37) produce antagonists with increased affinity, J. Med. Chem., 46:2427-2435 (2003)).

"Aryl" is phenyl or phenyl vicinally-fused with a saturated, partially-saturated, or unsaturated 3-, 4-, or 5 membered carbon bridge, the phenyl or bridge being substituted by 0, 1, 2 or 3 substituents selected from $C_{18}$ alkyl, $C_{14}$ haloalkyl or halo.

"Heteroaryl" is an unsaturated 5, 6 or 7 membered monocyclic or partially-saturated or unsaturated 6-, 7-, 8-, 9-, 10- or 11 membered bicyclic ring, wherein at least one ring is unsaturated, the monocyclic and the bicyclic rings containing 1, 2, 3 or 4 atoms selected from N, O and S, wherein the ring is substituted by 0, 1, 2 or 3 substituents selected from $C_{18}$ alkyl, $C_{14}$ haloalkyl and halo.

Although not essential for the practice of the present invention, assay methods for the detection of preferential binding to $CGRP_1$ receptor are known in the art (e.g., McLatchie et al., Nature, 393:333-339 (1998); Rist et al., J. Med. Chem., 41:117-123 (1998)), and are further exemplified herein below.

A "CGRP peptide antagonist" is a CGRP peptide, such as, but not limited to, a CGRP peptide analog, that antagonizes, blocks, decreases, reduces, impedes, or inhibits $CGRP_1$ receptor activation by full length native human αCGRP or βCGRP under physiological conditions of temperature, pH, and ionic strength. CGRP peptide antagonists include full and partial antagonists. The present invention does not depend on any particular mechanism of antagonism. For example, the CGRP peptide antagonist can act as a competitive antagonist or a noncompetitive antagonist. Such antagonist activity can be detected by known in vitro methods or in vivo functional assay methods. (See, e.g., Smith et al., Modifications to the N-terminus but not the C-terminus of calcitonin gene-related peptide(8-37) produce antagonists with increased affinity, J. Med. Chem., 46:2427-2435 (2003)).

The CGRP peptide is comprised of at least 2 to about 90 amino acid residues connected in a main chain by peptide bonds. Amino acid residues are commonly categorized according to different chemical and/or physical characteristics. The term "acidic amino acid residue" refers to amino acid residues in D- or L-form having side chains comprising acidic groups. Exemplary acidic residues include aspartate and glutamate residues. The term "aromatic amino acid residue" refers to amino acid residues in D- or L-form having side chains comprising aromatic groups. Exemplary aromatic residues include tryptophan, tyrosine, 3-(1-naphthyl)alanine, or phenylalanine residues. The term "basic amino acid residue" refers to amino acid residues in D- or L-form having side chains comprising basic groups. Exemplary basic amino acid residues include histidine, lysine, homolysine, ornithine, arginine, N-methyl-arginine, ω-aminoarginine, ω-methylarginine, 1-methyl-histidine, 3-methyl-histidine, and homoarginine (hR) residues. The term "hydrophilic amino acid residue" refers to amino acid residues in D- or L-form having side chains comprising polar groups. Exemplary hydrophilic residues include cysteine, serine, threonine, histidine, lysine, asparagine, aspartate, glutamate, glutamine, and citrulline (Cit) residues. The terms "lipophilic amino acid residue" refers to amino acid residues in D- or L-form having sidechains comprising uncharged, aliphatic or aromatic groups. Exemplary lipophilic sidechains include phenylalanine, isoleucine, leucine, methionine, valine, tryptophan, and tyrosine. Alanine (A) is amphiphilic—it is capable of acting as a hydrophilic or lipophilic residue. Alanine, therefore, is included within the definition of both "lipophilic residue" and "hydrophilic residue." The term "nonfunctional amino acid residue" refers to amino acid residues in D- or L-form having side chains that lack acidic, basic, or aromatic groups. Exemplary neutral amino acid residues include methionine, glycine, alanine, valine, isoleucine, leucine, and norleucine (Nle) residues.

The CGRP peptide includes a first $CGRP_1$ receptor binding region, or domain, proximal to its carboxy terminal end, which binding region preferentially binds a first binding site on a CRLR-RAMP1 complex. The phrase "proximal to the carboxy terminal end" means close to the peptide's C-terminal amino acid residue (regardless of any lack of a free carboxyl group thereon) by way of the peptide's primary structure, i.e., its amino acid sequence (also known as "primary sequence"), not relating to actual spatial distance or other secondary or higher order structural considerations, or, to whether vehicle is conjugated thereto. Typically, the first $CGRP_1$ receptor binding region involves the ten amino acid residues most proximal to, and including, the carboxy terminal residue of the peptide, at amino acid positions 28-37 relative to the positional order of the native human αCGRP sequence. However, as long as the peptide retains detectable specific or preferential binding to CRLR-RAMP1 complex, the first $CGRP_1$ receptor binding region may be 1, 2, 3, 4, or about 5 amino acid residues longer, or 1, 2, or about 3 amino acid residues shorter, than the $CGRP_1$ receptor binding region at amino acid positions 28-37 of the native human αCGRP sequence.

In some embodiments, the CGRP peptide also includes, from the first $CGRP_1$ receptor binding region to the N-terminal end of the peptide: a hinge region; and a second CGRP1 receptor binding region between the hinge region and the N-terminal end of the peptide. Thus, the hinge region or domain, is more distal from the carboxy terminal end of the peptide than the first $CGRP_1$ receptor binding region. The phrase "more distal" means more distant than a certain referent (such as the first $CGRP_1$ receptor binding region) from the peptide's C-terminal amino acid residue (regardless of any lack of a free carboxyl group thereon) by way of the peptide's primary structure, i.e., its amino acid sequence (or "primary sequence"), not relating to actual spatial distance or other secondary or higher order structural considerations, or to whether vehicle is conjugated thereto. The hinge region provides a movable joint or axis in the peptide that facilitates, participates in, or responds to, $CGRP_1$ receptor-specific binding by permitting the peptide to bend to better stabilize a peptide-CRLR-RAMP1 complex. Typically, the hinge region involves the nine amino acid residues at amino acid positions 19-27 relative to the positional order of the native human αCGRP sequence. However, a peptide that retains detectable specific or preferential binding to CRLR-RAMP1 complex, can have a hinge region 1, 2, 3, 4, 5, 6, 7, 8, 9 or about 10 amino acid residues longer, or 1, 2, 3, 4, 5, or about 6 amino acid residues shorter, than the hinge region at amino acid positions 19-27 of the native human αCGRP sequence.

Being between the hinge region and the N-terminal end of the peptide, the second $CGRP_1$ receptor binding region or domain, when present, is located even more distally from the carboxy terminal end than the hinge region. The phrase "even more distal" means at a greater distance than a certain referent (such as the hinge region) from the CGRP peptide's C-terminal amino acid residue (regardless of any lack of a free carboxyl group thereon) by way of the peptide's primary structure, i.e., its amino acid sequence (also known as "primary sequence"), not relating to actual spatial distance or other secondary or higher order structural considerations, or to whether vehicle is conjugated thereto. The second $CGRP_1$ receptor binding region is involved in increasing the binding affinity of the CGRP peptide either through direct binding to the CRLR-RAMP1 complex and/or via interacting with, or otherwise affecting the conformation of, the first $CGRP_1$ receptor binding region. Typically, the second $CGRP_1$ receptor binding region, if present, involves eleven amino acid residues at amino acid positions 8-18 relative to the native human αCGRP sequence. However, a peptide that retains detectable specific binding to CRLR-RAMP1 complex, can have, if present at all, a second $CGRP_1$ receptor binding region 1, 2, 3, 4, 5, 6, 7, 8, 9, or about 10 amino acid residues shorter than the $CGRP_1$ receptor binding region at amino acid positions 8-18 of the native human αCGRP sequence (SEQ ID NO:43), or can have a second $CGRP_1$ receptor binding region longer by 1 or more amino acid residues up to the maximum length of the CGRP peptide, as described herein.

The CGRP peptide lacks a "functional $CGRP_1$ receptor activation" region that is capable of detectably activating a $CGRP_1$ receptor (or of activating an amylin receptor, adrenomedullin receptor, or CT receptor) at a physiologically or pharmacologically relevant concentration of the peptide. Although not required for the practice of the invention, the skilled artisan is aware of suitable functional assays for detecting $CGRP_1$ receptor activation, or lack thereof, such as a cAMP-based assay system. In some embodiments the peptide has an amino acid sequence that includes amino acid positions 1-7, or any portion thereof, relative to the native CGRP sequence, however modified, such that the peptide cannot functionally activate the $CGRP_1$ receptor.

The CGRP peptide (or a peptide portion of the pharmaceutically acceptable vehicle, when applicable as described herein) can be obtained by synthesis employing conventional chemical synthetic methods. For example, solid phase peptide synthesis techniques can be used. Such techniques are well known in the art and include but are not limited to, those described in Merrifield (1973), Chem. Polypeptides, 335-361 (Katsoyannis and Panayotis eds.); Merrifield (1963), J. Am. Chem. Soc., 85:2149; Davis et al. (1985), Biochem. Intl., 10:394-414; Stewart and Young (1969), Solid Phase Peptide Synthesis; U.S. Pat. No. 3,941,763; Finn et al. (1976), The Proteins (3rd ed.) 2:105-253; and Erickson et al., The Proteins (3rd ed.) 2: 257-527 (1976). The use of protecting groups, linkers, and solid phase supports, as well as specific protection and deprotection reaction conditions, linker cleavage conditions, use of scavengers, and other aspects of solid phase peptide synthesis are well known and are also described in "Protecting Groups in Organic Synthesis," 3rd Edition, T. W. Greene and P. G. M. Wuts, Eds., John Wiley & Sons, Inc., 1999; NovaBiochem Catalog, 2000; "Synthetic Peptides, A User's Guide," G. A. Grant, Ed., W.H. Freeman & Company, New York, N.Y., 1992; "Advanced Chemtech Handbook of Combinatorial & Solid Phase Organic Chemistry," W. D. Bennet, J. W. Christensen, L. K. Hamaker, M. L. Peterson, M. R. Rhodes, and H. H. Saneii, Eds., Advanced Chemtech, 1998; "Principles of Peptide Synthesis, 2nd ed.," M. Bodanszky, Ed., Springer-Verlag, 1993; "The Practice of Peptide Synthesis, 2nd ed.," M. Bodanszky and A. Bodanszky, Eds., Springer-Verlag, 1994; "Protecting Groups," P. J. Kocienski, Ed., Georg Thieme Verlag, Stuttgart, Germany, 1994; "Fmoc Solid Phase Peptide Synthesis, A Practical Approach," W. C. Chan and P. D. White, Eds., Oxford Press, 2000, G. B. Fields et al., Synthetic Peptides: A User's Guide, 1990, 77-183, and elsewhere. A further illustration of peptide synthesis techniques that can be employed in accordance with the present invention is found in FIG. 13.

Typically, linear and cyclic CGRP peptides are synthesized using Fmoc solid-phase peptide synthesis (SPPS) methodologies on a commercially available synthesizer, such as a Symphony automated synthesizer (Protein Technologies, Inc., Washington, D.C.) or a Liberty microwave assisted automated synthesizer (CEM Corporation, Matthews, N.C.). Protected derivatives of conical amino acids, Fmoc-Dpr(Mtt)-OH, Fmoc-Dab(Mtt)-OH, and Fmoc-Cit-OH can be purchased from EMD Biosciences, Inc. (La Jolla, Calif.). Fmoc-homoArg(Pmc)-OH can be purchased from Bachem California, Inc. (Torrance, Calif.). All other non-conical Fmoc-amino acids can be purchased from either Advanced Chemtech (Louisville, Ky.) or Chem-Impex International, Inc. (Wood Dale, L). The coupling reagents 2-(1-H-benzotriazol-1-yl)-1,1,3,3-tetramethyluronium hexafluorophosphate (HBTU) and 1-Benzotriazoyloxytris(pyrrolidino)phosphonium hexafluorophosphate (PyBOP) can be purchased from Matrix Innovation, Inc. (Montreal, Quebec Canada). N-Methyl Pyrrolidone (NMP), dichloromethane (DCM), methanol (MeOH), acetonitrile (ACN), isopropanol, dimethylsulfoxide (DMSO), and anhydrous ethyl ether can be purchased from VWR International (West Chester, Pa.). N,N-dimethylformamide (DMF) is purchased from EMD Biosciences. Trifluoroacetic acid (TFA), N-ethylmorpholine (NEM), pyridine, piperidine, N—N-diisopropylethylamine (DIEA), triisopropylsilane (Tis), phenol, acetic anhydride, and 0.1% TFA in $H_2O$ are purchased from Sigma-Aldrich (St. Louis, Mo.). All solvents and reagents are preferably ACS grade or better and can be used without further purification. Peptides are assembled on CLEAR-amide-MBHA resin (0.44 meq/g substitution), purchased from Peptides International (Louisville, Ky.). Typically, the syntheses are performed using 16 mL polypropylene reaction vessels fitted with course frits (Protein Technologies). Approximately 455 mg resin (0.2 mmole) is added to each reaction vessel and solvated for 10 min in DMF. The growing peptide chains are assembled on the amide-resin starting from the C-terminus using the general amino acid cycle as follows: The $N^\alpha$-Fmoc groups are removed by addition of 5 mL 20% piperidine in DMF for 5 min, followed by a 20 min 5 mL incubation. Amino acids (3-fold molar excess) are added to the resin (3000 μL of 0.2 M amino acid solution in NMP), followed by the addition of 3-fold excess HBTU and 6-fold excess NEM (1.2 mL of 0.5 M HBTU & 1.0 M NEM in DMF). The mixture is agitated by periodic sparging with nitrogen for 45 min, followed by emptying of the reaction vessel by positive nitrogen pressure. The resin is washed with 5 mL of DMF (4×30 sec). A second coupling reaction is repeated for 30 min, the reaction vessel emptied, and the $N^\alpha$-Fmoc-protected peptide-resin is washed with 5 mL DMF (3×30 sec) and 5 mL DCM (2×30 sec). The amino acid coupling cycle is repeated with required amino acids until the desired peptide is assembled. Following $N^\alpha$-Fmoc deprotection of the final amino acid, acetylation of the $N^\alpha$-amine is performed by addition of 2.5 mL acetic anhydride/DIEA solution (1.0 M in DMF) to the reaction vessels and mixed for 30 min. If peptides do not require cyclization, the acetylated peptide-resin is washed with 5 mL DCM (5×30 sec) and dried thoroughly prior to cleavage from the resin and removal of side chain protecting groups. Deprotection of the amino acid side chains and cleavage of the acetylated-peptide from the resin is performed by incubating the peptide-resin with 15 mL cleavage cocktail (92.5% TFA, 2.5% water, 2.5% T is, 2.5% phenol) for 3 hr. The cleavage product is filtered under positive nitrogen gas pressure into tarred 50 mL polypropylene conical tubes. The resin is washed with 10 mL cleavage cocktail for 5 min, filtered, and the filtrates combined. The cleavage solutions are concentrated to approximately 5 mL total volume tinder a gentle stream of nitrogen. Cold (−20° C.) anhydrous ethyl ether (up to 50 mL) is added to the filtrates. The flocculent peptides are pelleted by centrifugation (e.g., Eppendorf centrifuge 5702 using a swinging bucket rotor) at 3800 rpm for 5 min and the ether is decanted. The peptide pellets are washed with additional cold anhydrous ethyl ether (up to 50 mL), pelleted by centrifugation, decanted, and dried in vacuo. The crude peptide yields typically range from 60% to 99% of the theoretical yields. Crude peptides are dissolved in DMSO and purified by RP-HPLC using, e.g., an Agilent 1100 preparative chromatography system with a photodiode array detector (Agilent Technologies, Inc., Santa Clara, Calif.) and a preparative RP-HPLC bonded silica column (Phenomenex Jupiter C18(2), 300 Å, 10 μM, 50×250 mm) and lyophilized to form amorphous solids. The purified peptides are preferably at least >95% pure as determined by the analytical RP-HPLC using a linear gradient of 2-60% B over 60 min (A=0.1% TFA in $H_2O$, B=0.1% TFA in CAN, column=Phenomenex Jupiter Proteo, 90 Å, 4 μM, 2.1×50 mm). Correct molecular mass can be confirmed by LC-MS methodologies using, e.g., a Waters Acquity HPLC equipped with a LCT Premier XE orthogonal acceleration time-of-flight (oa-TOF) benchtop mass spectrometer (Waters Corporation, Milford, Mass.). CGRP peptide antagonists cyclized with a lactam bridge are prepared by selectively incorporating residues with nucleophilic side chains that will form the lactam protected with 4-methyltrityl (Mtt) and electrophilic side chains with 2-phenyl-isopropyl (2-PhiPr). Amino acids involved in the cyclizations are purchased from EMD Biosciences, Inc. All other amino acids used in the syntheses are preferably standard t-butyl, pentamethyldihydrobenzofuran-5-sulfonyl, or pentamethylchroman-6-sulfonyl side-chain protected Fmoc amino acids. Mtt and 2-PhiPr groups are selectively removed from cyclic CGRP peptide antagonists by addition of 10 mL TFA/T is/DCM (0.3:0.5:9.2) to the peptide-resin (5×10 min), followed by washing the peptide-resin with 10 mL of a 2% DIEA solution (2×2 min) and 10 mL DCM (4×1 min). The lactam bridge in cyclic peptides are formed by activating electrophilic carboxyl groups with 5-fold excess PyBOP 7-fold excess DIEA in DMF. The mixtures are agitated with continuous sparging with nitrogen. Reactions are monitored by cleavage of a 1-2 mg aliquot of peptide-resin in 400 μL of cleavage cocktail, followed by filtration, concentration of the filtrate under nitrogen, and analyzing by LC-MS methodologies previously described for linear peptides. Lactam formation ranges from 70-99% after approximately 1-4 days at room temperature. The peptide-resin is washed with DMF, acetylated, and washed again with DCM following the cyclization reactions and thoroughly dried in vacuo prior to cleavage. Cyclic peptide-resins are cleaved, purified, and analyzed in the same manner as described for linear peptides. The preceding methods are merely illustrative, and the skilled artisan is aware of various other methods and technical variations for synthesizing the inventive CGRP peptides.

The CGRP peptide can also be obtained using recombinant DNA- and/or RNA-mediated protein expression techniques, or any other methods of preparing peptides or, when applicable, fusion proteins. For example, the peptides can be made in transformed host cells. Briefly, a recombinant DNA molecule coding for the peptide is prepared. Methods of preparing such DNA molecules are well known in the art. For instance, sequences encoding the peptides can be excised from DNA using suitable restriction enzymes. Alternatively, the DNA molecule can be synthesized using chemical synthesis techniques, such as the phosphoramidate method. Also, a combination of these techniques can be used. Any of a large number of available and well-known host cells may be used in the practice of this invention. The selection of a particular host is dependent upon a number of factors recognized by the art. These include, for example, compatibility with the chosen expression vector, toxicity of the peptides encoded by the DNA molecule, rate of transformation, ease of recovery of the peptides, expression characteristics, bio-safety and costs. A balance of these factors must be struck with the understanding that not all hosts may be equally effective for the expression of a particular DNA sequence. Within these general guidelines, useful microbial hosts include bacteria (such as *E. coli* sp.), yeast (such as *Saccharomyces* sp.) and other fungi, insects, plants, mammalian (including human) cells in culture, or other hosts known in the art. Modifications can be made at the DNA level, as well. The peptide-encoding DNA sequence may be changed to codons more compatible with the chosen host cell. For *E. coli*, optimized codons are known in the art. Codons can be substituted to eliminate restriction sites or to include silent restriction sites, which may aid in processing of the DNA in the selected host cell. Next, the transformed host is cultured and purified. Host cells may be cultured under conventional fermentation conditions so that the desired compounds are expressed. Such fermentation conditions are well known in the art.

Obtaining the CGRP peptide, whether the peptide is prepared by synthetic or recombinant techniques, can also involve suitable protein purification techniques, when applicable. In some embodiments of the vehicle-conjugated CGRP peptide antagonists of the invention, the CGRP peptide portion can be prepared to include a suitable isotopic label (e.g., $^{125}$I, $^{14}$C, $^{13}$C, $^{35}$S, $^{3}$H, $^{2}$H, $^{13}$N, $^{15}$N, $^{18}$O, $^{17}$O, etc.), for ease of quantification or detection.

In accordance with the present invention, "obtained" or "obtaining" a CGRP peptide means that the peptide is prepared, synthesized, produced, brought into existence, purified, isolated, gotten and/or purchased.

In useful embodiments of the invention, the CGRP peptide is modified in one or more ways relative to a native CGRP sequence of interest, such as a native human αCGRP or βCGRP sequence. The one or more useful modifications can include amino acid additions or insertions, amino acid deletions, peptide truncations, amino acid substitutions, and/or chemical derivatization of amino acid residues, accomplished by known chemical techniques. For example, the thusly modified amino acid sequence includes at least one amino acid residue inserted or substituted therein, relative to the amino acid sequence of the native CGRP sequence of interest, in which the inserted or substituted amino acid residue has a side chain comprising a nucleophilic or electrophilic reactive functional group by which the peptide is conjugated to the vehicle. In accordance with the invention, useful examples of such a nucleophilic or electrophilic reactive functional group include, but are not limited to, a thiol, a primary amine, a seleno, a hydrazide, an aldehyde, a carboxylic acid, a ketone, an aminooxy, a masked (protected) aldehyde, or a masked (protected) keto functional group. Examples of amino acid residues having a side chain comprising a nucleophilic reactive functional group include, but are not limited to, a lysine residue, a homolysine, an α,β-diaminopropionic acid residue, an α,γ-diaminobutyric acid residue, an ornithine residue, a cysteine, a homocysteine, a glutamic acid residue, an aspartic acid residue, or a selenocysteine residue.

The useful CGRP peptide according to the present invention can have one or more amino acid additions or insertions, amino acid deletions, peptide truncations, amino acid substitutions, and/or chemical derivatizations of amino acid residues, relative to the sequence of a peptide whose sequence is described herein, so long as the requisite $CGRP_1$ receptor antagonist activity is maintained. Examples of the inventive CGRP peptide antagonists include CGRP peptides having an amino acid primary sequence of any of those set forth in Table 2A, Table 2B, Table 2C, Table 2D, Table 3A, Table 3B, Table 3 (except SEQ ID NO: 1), Table 4, or Table 7, whether shown in vehicle-conjugated or unconjugated form.

For example, additional amino acid residues can be included at the N-terminal end of the CGRP peptide, as long as they do not significantly reduce the potency of $CGRP_1$ receptor binding or otherwise interfere with $CGRP_1$ receptor antagonism. For example, in some embodiments, an aromatic amino acid residue, such as a tryptophan or tyrosine residue, can be a useful addition at the N-terminal end of the peptide as a chromophore for quantification or detection purposes, or can, in some embodiments, actually improve potency. Such additions can also be made to N-terminally truncated CGRP peptide analogs as described herein.

In some embodiments of the present invention, it is useful that the CGRP peptide's sequence include an N-terminal truncation from a native CGRP peptide amino acid sequence length (e.g., deletion of entirety, or part, of the activation region or of the second binding region), for example, but not limited to, a peptide having an amino acid sequence length of a CGRP fragment, such as CGRP(8-37), CGRP(9-37), CGRP (10-37), CGRP(11-37), CGRP(12-37), CGRP(13-37), CGRP(14-37), CGRP(15-37), CGRP(16-37), CGRP(17-37), CGRP(18-37), CGRP(19-37), CGRP(20-37), CGRP(21-37), CGRP(22-37), CGRP(23-37), CGRP(24-37), CGRP(25-37), CGRP(26-37), CGRP(27-37), or CGRP(28-37), regardless of whether the fragment has a native amino acid sequence or is a CGRP analog sequence in other respects. Nevertheless, in accordance with the invention, such N-terminally truncated sequences can, in certain embodiments, have other amino acid residues added or attached at the N-terminal end to form a N-terminal region of, preferably, 1 to about 50 amino acid residues, more preferably, 1 to about 30 amino acid residues, and most preferably, 1 to about 10 amino acid residues (e.g., a peptide linker, aromatic amino acid residue(s), or one or more copies of $CGRP_1$ receptor binding regions, as described herein).

In further describing the CGRP peptide herein, a one-letter abbreviation system is frequently applied to designate the identities of the twenty "canonical" amino acid residues generally incorporated into naturally occurring peptides and proteins (Table 1). Such one-letter abbreviations are entirely interchangeable in meaning with three-letter abbreviations, or non-abbreviated amino acid names. Within the one-letter abbreviation system used herein, an upper case letter indicates a L-amino acid, and a lower case letter indicates a D-amino acid. For example, the abbreviation "R" designates L-arginine and the abbreviation "r" designates D-arginine.

TABLE 1

One-letter abbreviations for the canonical amino acids. Three-letter abbreviations are in parentheses.

| | |
|---|---|
| Alanine (Ala) | A |
| Glutamine (Gln) | Q |
| Leucine (Leu) | L |
| Serine (Ser) | S |
| Arginine (Arg) | R |
| Glutamic Acid (Glu) | E |
| Lysine (Lys) | K |

TABLE 1-continued

One-letter abbreviations for the canonical amino acids. Three-letter abbreviations are in parentheses.

| | |
|---|---|
| Threonine (Thr) | T |
| Asparagine (Asn) | N |
| Glycine (Gly) | G |
| Methionine (Met) | M |
| Tryptophan (Trp) | W |
| Aspartic Acid (Asp) | D |
| Histidine (His) | H |
| Phenylalanine (Phe) | F |
| Tyrosine (Tyr) | Y |
| Cysteine (Cys) | C |
| Isoleucine (Ile) | I |
| Proline (Pro) | P |
| Valine (Val) | V |

An amino acid substitution in an amino acid sequence is typically designated herein with a one-letter abbreviation for the amino acid residue in a particular position, followed by the numerical amino acid position relative to the native CGRP sequence of interest (human αCGRP sequence, unless otherwise specified), which is then followed by the one-letter symbol for the amino acid residue substituted in. For example, "T30D" symbolizes a substitution of a threonine residue by an aspartate residue at amino acid position 30, relative to the native human αCGRP sequence (i.e., SEQ ID NO:43), which serves herein as a reference sequence. By way of further example, "R18hR" or "R18Cit" indicates a substitution of an arginine residue by a homoarginine (herein abbreviated "hR" or "hArg") residue or a citrulline (herein abbreviated "Cit") residue, respectively, at amino acid position 18, relative to the native human αCGRP sequence (i.e., SEQ ID NO:43). An amino acid position within the amino acid sequence of any particular CGRP peptide (or CGRP peptide analog) described herein may differ from its position relative to the native human αCGRP sequence, i.e., as determined in an alignment of the C-terminal end of the peptide's amino acid sequence with the C-terminal end of the native human αCGRP sequence. For example, amino acid position 1 of the sequence VTHRLAGLLSRSGGVVKNNFVPTNVGSKAF (SEQ ID NO:1; human αCGRP(8-37)), thus aligned, corresponds to amino acid position 8 relative to the native human αCGRP reference sequence (SEQ ID NO:43), and amino acid position 30 of SEQ ID NO:1 corresponds to amino acid position 37 relative to the native human αCGRP reference sequence (SEQ ID NO:43). As a further example, addition of a tryptophan at the N-terminus of a peptide having an amino acid sequence SEQ ID NO:1 constitutes a "W0 addition," but in relation to the sequence WVTHRLAGLLSRSGGVVKNN-FVPTNVGSKAF (SEQ ID NO:4), the tryptophan is at amino acid position 1, while it corresponds to amino acid position 7 relative to the native human αCGRP sequence (SEQ ID NO:43).

In some useful embodiments of the inventive composition of matter, the amino acid sequence of the CGRP peptide includes the following three amino acid substitutions: N31D, S34P, and K35F, relative to the native human αCGRP sequence (SEQ ID NO:43). These three substitutions were found to improve the potency of some CGRP peptide antagonists at the $CGRP_1$ receptor, as demonstrated herein below.

In certain embodiments of the present invention, amino acid substitutions encompass, non-canonical amino acid residues, which include naturally rare (in peptides or proteins) amino acid residues or unnatural amino acid residues. Non-canonical amino acid residues can be incorporated into the peptide by chemical peptide synthesis rather than by synthe-sis in biological systems, such as recombinantly expressing cells, or alternatively the skilled artisan can employ known techniques of protein engineering that use recombinantly expressing cells. (See, e.g., Link et al., Non-canonical amino acids in protein engineering, Current Opinion in Biotechnology, 14(6):603-609 (2003)). The term "non-canonical amino acid residue" refers to amino acid residues in D- or L-form that are not among the 20 canonical amino acids generally incorporated into naturally occurring proteins, for example, β-amino acids, homoamino acids, cyclic amino acids and amino acids with derivatized side chains. Examples include (in the L-form or D-form; abbreviated as in parentheses): citrulline (Cit), homocitrulline (hCit), $N^\alpha$-methylcitrulline (NMeCit), $N^\alpha$-methylhomocitrulline ($N^\alpha$-MeHoCit), ornithine (Orn), $N^\alpha$-Methylornithine ($N^\alpha$-MeOrn or NMeOrn), sarcosine (Sar), homolysine (hLys or hK), homoarginine (hArg or hR), homoglutamine (hQ), $N^\alpha$-methylarginine (NMeR), $N^\alpha$-methylleucine ($N^\alpha$-MeL or NMeL), N-methyl-homolysine (NMeHoK), $N^\alpha$-methylglutamine (NMeQ), norleucine (Nle), norvaline (Nva), 1,2,3,4-tetrahydroisoquinoline (Tic), Octahydroindole-2-carboxylic acid (Oic), 3-(1-naphthyl)alanine (1-Nal), 3-(2-naphthyl)alanine (2-Nal), 1,2,3,4-tetrahydroisoquinoline (Tic), 2-indanylglycine (Igl), para-iodophenylalanine (pI-Phe), para-aminophenylalanine (4AmP or 4-Amino-Phe), 4-guanidino phenylalanine (Guf), nitrophenylalanine (nitrophe), aminophenylalanine (aminophe or Amino-Phe), benzylphenylalanine (benzylphe), γ-carboxyglutamic acid (γ-carboxyglu), hydroxyproline (hydroxypro), p-carboxyl-phenylalanine (Cpa), α-aminoadipic acid (Aad), Nα-methyl valine (NMeVal), N-α-methyl leucine (NMeLeu), Nα-methylnorleucine (NMeNle), cyclopentylglycine (Cpg), cyclohexylglycine (Chg), acetylarginine (acetylarg), α,β-diaminopropionoic acid (Dpr), α,γ-diaminobutyric acid (Dab), diaminopropionic acid (Dap), cyclohexylalanine (Cha), 4-methyl-phenylalanine (MePhe), β,β-diphenyl-alanine (BiPhA), aminobutyric acid (Abu), 4-phenyl-phenylalanine (or biphenylalanine; 4Bip), α-amino-isobutyric acid (Aib), beta-alanine, beta-aminopropionic acid, piperidinic acid, aminocaprioic acid, aminoheptanoic acid, aminopimelic acid, desmosine, diaminopimelic acid, N-ethylglycine, N-ethylaspargine, hydroxylysine, allo-hydroxylysine, isodesmosine, allo-isoleucine, N-methylglycine, N-methylisoleucine, N-methylvaline, 4-hydroxyproline (Hyp), γ-carboxyglutamate, ε-N,N,N-trimethyllysine, ε-N-acetyllysine, O-phosphoserine, N-acetylserine, N-formylmethionine, 3-methylhistidine, 5-hydroxylysine, ω-methylarginine, and other similar amino acids, and derivatized forms of any of these as described herein. Table 1A contains some exemplary non-canonical amino acid residues that are useful in accordance with the present invention and associated abbreviations as typically used herein, although the skilled practitioner will understand that different abbreviations and nomenclatures may be applicable to the same substance and my appear interchangeably herein.

TABLE 1A

Useful non-canonical amino acids for amino acid addition, insertion, or substitution into CGRP peptide sequences in accordance with the present invention. In the event an abbreviation listed in Table 1A differs from another abbreviation for the same substance disclosed elsewhere herein, both abbreviations are understood to be applicable.

| Abbreviation | Amino Acid |
|---|---|
| Sar | Sarcosine |
| Nle | norleucine |

TABLE 1A-continued

Useful non-canonical amino acids for amino acid addition, insertion, or substitution into CGRP peptide sequences in accordance with the present invention. In the event an abbreviation listed in Table 1A differs from another abbreviation for the same subst (1992)]. On this basis multiple sites within a given peptide or protein can be recognized and processed by different proteases.

Figure 3:
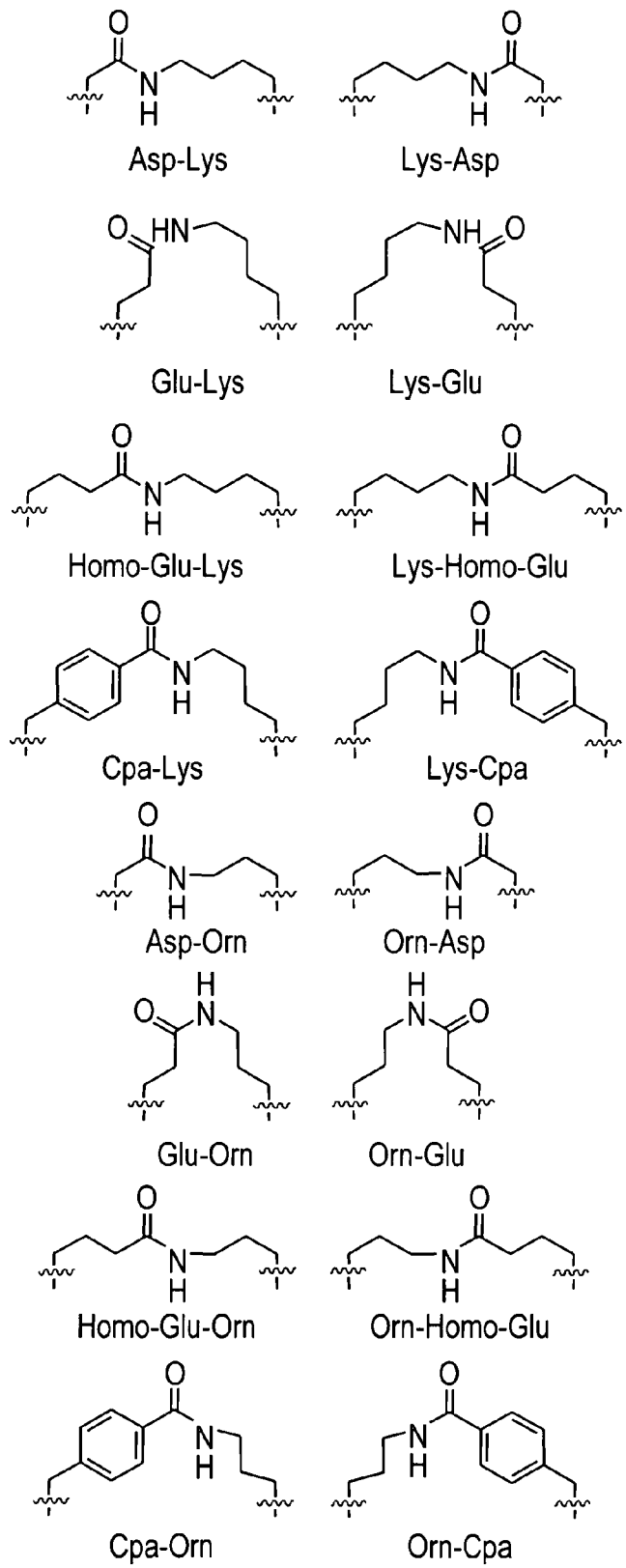
FIG. 3 depicts some embodiments of the positions within a CGRP peptide that are separated by 1 or more amino acids that can be joined to form a cyclic lactam.

With the objective of increasing the stability of CGRP in biological fluid we have investigated the rate and site of CGRP breakdown by enzyme-linked immunosorbent assay (ELISA) and mass spectrometry analysis techniques. After the identification of key degradation site in CGRP and CGRP analogues using this approach, we have replaced selected natural amino acids with non-canonical or unnatural amino acids to reduce protease processing and in turn increase the stability of the CGRP peptide in plasma. Examples of this approach are the replacement of arginine (R) with citrulline, and phenylalanine (F) with 3-(1-naphthyl)alanine. We have also cyclized side-chain to side-chain (for example, i, i+4 residues) to form ring structures which also increase overall plasma stability (See, e.g., FIG. 3 and FIG. 13). The introduction of non-canonical or unnatural amino acids and cyclic structures has been carried out in an iterative manner to identify novel CGRP analogues with significantly improved stability in biological fluid (e.g., 100% plasma) with or without PEGylation (20 kDa MeO-PEG), as illustrated in Table 1B below, and as further described in Examples 4-6, herein below.

TABLE 1B

Half-life of some modified CGRP peptides in 100% plasma.

| Stability in undiluted plasma at 37° C. as determined by ELISA | SEQ ID NO: 172* | SEQ ID NO: 173* |
| --- | --- | --- |
| $t_{1/2}$ in rat plasma | 8-9 h | 8-9 h |
| $t_{1/2}$ in Cynomolgus plasma | >24 h | >24 h |
| $t_{1/2}$ in human plasma | >24 h | >24 h |

*SEQ ID 172 and SEQ ID 173 are both PEGylated (20 kDa MeO-PEG) at $Lys^{25}$.

Accordingly, in some embodiments of the inventive composition of matter, a modification, such as, but not limited to, an amino acid substitution of a basic amino acid residue (such as a basic amino acid residue described herein above, or a functionally equivalent substitution) is at amino acid position positions 3, 4, 9, 10, 11, 12, 14, 15, 16, 17, 18, 19, 24, 25, 26, 27, 29, 30, 31, 33, 34, 35, 36, and/or 37, and more preferably, at positions 3, 4, 11, 18, 24, 25, 34, 35 and/or 37, or at any combination of these positions, relative to the human αCGRP reference sequence (SEQ ID NO:43). By way of further example, in some embodiments, a substitution is made at a residue that is adjacent to a proteolytic cleavage site to prevent or reduce enzymatic proteolysis, e.g., a S17P and/or S19P substitution, relative to the human αCGRP sequence (SEQ ID NO:43). In other embodiments, substitution of a charged residue, such as hArg or Guf, at position 24 relative to the native human αCGRP reference sequence (SEQ ID NO:43) enhances the proteolytic stability of the CGRP peptide.

In certain embodiments, the modification is a single amino acid substitution, e.g.:
R11Q;
R11hR;
R11Cit;
R11hK;
R11Orn;
R11Cit;
R11hCit;
R11NMeR;
R11NMeQ;
R11NMeHoK;
R11NmeOrn;
R11NMeCit;
R11NMeHoCit;
R18Q;
R18hR;
R18Cit;
R18NMeR;
R18NmeQ; and
R18NMeCit, or a functionally equivalent amino acid substitution, or in some other embodiments, any combination of these that entails an amino acid substitution at both position II and position 18, relative to the native human αCGRP sequence.

In certain embodiments, modification can involve double or multiple amino acid substitutions, including modifications at amino acid positions 3, 4, 9, 10, 11, 12, 14, 15, 16, 17, 18, 19, 24, 25, 26, 27, 29, 30, 31, 33, 34, 35, 36, and/or 37, and more preferably, at positions 3, 4, 11, 18, 24, 25, 34, 35 and/or 37, or at any combination of these positions, relative to the human αCGRP reference sequence (SEQ ID NO:43), e.g.:
R11hCit, R18hCit;
R11hK, R18hK;
R11NMeR, R18NMeR;
R11NMeR, R18NMeR, K24NMeR;
R11Cit, L12NMeL, R18Cit;
R11Cit, L12Nle, L15Nle, L16Nle, R18Cit;
R11Cit, L12Nva, L15Nva, L16Nva, R18Cit;
R11Cit, S17T, R18Cit;
H10Tic, R11Cit, R18Cit;
R11Cit, G14Sar, R18Cit;
R11Cit, L12Nle, L15Nle, L16Nle, S17T, R18Cit, K24hR, G33Sar;
R11hCit, L12Nle, L15Nle, L16Nle, S17T, R18hCit, K24hR, G33Sar;
R11NMeR, L12Nle, L15Nle, L16Nle, S17T, R18NMeR, K24NMeR, G33Sar; and
R11NMeR, L12Nva, L15Nva, L16Nva, S17T, R18NMeR, K24NMeR, G33Sar, or functionally equivalent amino acid substitutions at positions 10, 11, 12, 14, 15, 16, 17, 18, 19, 24 and/or 33.

The term "protease" is synonymous with "peptidase". Proteases comprise two groups of enzymes: the endopeptidases which cleave peptide bonds at points within the protein, and the exopeptidases, which remove one or more amino acids from either N- or C-terminus respectively. The term "proteinase" is also used as a synonym for endopeptidase. The four mechanistic classes of proteinases are: serine proteinases, cysteine proteinases, aspartic proteinases, and metallo-proteinases. In addition to these four mechanistic classes, there is a section of the enzyme nomenclature which is allocated for proteases of unidentified catalytic mechanism. This indicates that the catalytic mechanism has not been identified.

Cleavage subsite nomenclature is commonly adopted from a scheme created by Schechter and Berger (Schechter I. & Berger A., On the size of the active site in proteases. I. Papain, Biochemical and Biophysical Research Communication, 27:157 (1967); Schechter I. & Berger A., On the active site of proteases. 3. Mapping the active site of papain; specific peptide inhibitors of papain, Biochemical and Biophysical Research Communication, 32:898 (1968)). According to this model, amino acid residues in a substrate undergoing cleavage are designated P1, P2, P3, P4 etc. in the N-terminal direction from the cleaved bond. Likewise, the residues in the C-terminal direction are designated P1', P2', P3', P4'. etc.

The skilled artisan is aware of a variety of tools for identifying protease binding or protease cleavage sites of interest. For example, the PeptideCutter software tool is available through the ExPASy (Expert Protein Analysis System) proteomics server of the Swiss Institute of Bioinformatics (SIB; www.expasy.org/tools/peptidecutter). PeptideCutter searches a protein sequence from the SWISS-PROT and/or TrEMBL databases or a user-entered protein sequence for protease cleavage sites. Single proteases and chemicals, a selection or the whole list of proteases and chemicals can be used. Different forms of output of the results are available: Tables of cleavage sites either grouped alphabetically according to enzyme names or sequentially according to the amino acid number. A third option for output is a map of cleavage sites. The sequence and the cleavage sites mapped onto it are grouped in blocks, the size of which can be chosen by the user. Other tools are also known for determining protease cleavage sites. (E.g., Turk, B. et al., Determination of protease cleavage site motifs using mixture-based oriented peptide libraries, Nature Biotechnology, 19:661-667 (2001); Barrett A. et al., Handbook of proteolytic enzymes, Academic Press (1998)).

The serine proteinases include the chymotrypsin family, which includes mammalian protease enzymes such as chymotrypsin, trypsin or elastase or kallikrein. The serine proteinases exhibit different substrate specificities, which are related to amino acid substitutions in the various enzyme subsites interacting with the substrate residues. Some enzymes have an extended interaction site with the substrate whereas others have a specificity restricted to the PI substrate residue.

Trypsin preferentially cleaves at R or K in position P1. A statistical study carried out by Keil (1992) described the negative influences of residues surrounding the Arg- and Lys-bonds (i.e. the positions P2 and P1', respectively) during trypsin cleavage. (Keil, B., Specificity of proteolysis, Springer-Verlag Berlin-Heidelberg-New York, 335 (1992)). A proline residue in position P1' normally exerts a strong negative influence on trypsin cleavage. Similarly, the positioning of R and K in P1' results in an inhibition, as well as negatively charged residues in positions P2 and P1'.

Chymotrypsin preferentially cleaves at a W, Y or F in position P1 (high specificity) and to a lesser extent at L, M or H residue in position P1. (Keil, 1992). Exceptions to these rules are the following: When W is found in position P1, the cleavage is blocked when M or P are found in position P1' at the same time. Furthermore, a proline residue in position P1' nearly fully blocks the cleavage independent of the amino acids found in position P1. When an M residue is found in position P1, the cleavage is blocked by the presence of a Y residue in position P1'. Finally, when H is located in position P1, the presence of a D, M or W residue also blocks the cleavage.

Membrane metallo-endopeptidase (NEP; neutral endopeptidase, kidney-brush-border neutral proteinase, enkephalinase, EC 3.4.24.11) cleaves peptides at the amino side of hydrophobic amino acid residues. (Connelly, J C et al., Neutral Endopeptidase 24.11 in Human Neutrophils Cleavage of Chemotactic Peptide, PNAS, 82(24):8737-8741 (1985)).

Thrombin preferentially cleaves at an R residue in position P1. (Keil, 1992). The natural substrate of thrombin is fibrinogen. Optimum cleavage sites are when an R residue is in position P1 and Gly is in position P2 and position P1'. Likewise, when hydrophobic amino acid residues are found in position P4 and position P3, a proline residue in position P2, an R residue in position P1, and non-acidic amino acid residues in position P1' and position P2'. A very important residue for its natural substrate fibrinogen is a D residue in P10.

Caspases are a family of cysteine proteases bearing an active site with a conserved amino acid sequence and which cleave peptides specifically following D residues. (Earnshaw W C et al., Mammalian caspases: Structure, activation, substrates, and functions during apoptosis, Annual Review of Biochemistry, 68:383-424 (1999)).

The Arg-C proteinase preferentially cleaves at an R residue in position P1. The cleavage behavior seems to be only moderately affected by residues in position P1'. (Keil, 1992). The Asp-N endopeptidase cleaves specifically bonds with a D residue in position P1'. (Keil, 1992).

The foregoing is merely exemplary and by no means an exhaustive treatment of knowledge available to the skilled artisan concerning protease binding and/or cleavage sites that the skilled artisan may be interested in eliminating in practicing the invention.

Additional useful embodiments of vehicle-conjugated CGRP peptide antagonists can result from conservative modifications of the amino acid sequences of the vehicle-conjugated peptides disclosed herein. Conservative modifications will produce vehicle-conjugated peptides having functional, physical, and chemical characteristics similar to those of the vehicle-conjugated (e.g., PEG-conjugated) peptide from which such modifications are made. Such conservatively modified forms of the vehicle- or PEG-conjugated peptides disclosed herein are also contemplated as being an embodiment of the present invention.

In contrast, substantial modifications in the functional and/or chemical characteristics of the CGRP peptides may be accomplished by selecting substitutions in the amino acid sequence that differ significantly in their effect on maintaining (a) the structure of the molecular backbone in the region of the substitution, for example, as an α-helical conformation, (b) the charge or hydrophobicity of the molecule at the target site, or (c) the size of the molecule.

For example, a "conservative amino acid substitution" may involve a substitution of a native amino acid residue with a normative residue such that there is little or no effect on the polarity or charge of the amino acid residue at that position. Furthermore, any native residue in the polypeptide may also be substituted with alanine, as has been previously described for "alanine scanning mutagenesis" (see, for example, MacLennan et al., Acta Physiol. Scand. Suppl., 643:55-67 (1998); Sasaki et al., 1998, Adv. Biophys. 35:1-24 (1998), which discuss alanine scanning mutagenesis).

Desired amino acid substitutions (whether conservative or non-conservative) can be determined by those skilled in the art at the time such substitutions are desired. For example, amino acid substitutions can be used to identify important residues of the peptide sequence, or to increase or decrease the affinity of the peptide or vehicle-conjugated peptide molecules described herein.

Naturally occurring residues may be divided into classes based on common side chain properties:
1) hydrophobic: norleucine (Nor), Met, Ala, Val, Leu, Ile;
2) neutral hydrophilic: Cys, Ser, Thr, Asn, Gln;
3) acidic: Asp, Glu;
4) basic: His, Lys, Arg;
5) residues that influence chain orientation: Gly, Pro; and
6) aromatic: Trp, Tyr, Phe.

Conservative amino acid substitutions may involve exchange of a member of one of these classes with another member of the same class. Conservative amino acid substitutions may encompass non-naturally occurring amino acid residues, which are typically incorporated by chemical peptide synthesis rather than by synthesis in biological systems. These include peptidomimetics and other reversed or inverted forms of amino acid moieties.

Non-conservative substitutions may involve the exchange of a member of one of these classes for a member from another class. Such substituted residues may be introduced into regions of the human antibody that are homologous with non-human antibodies, or into the non-homologous regions of the molecule.

In making such changes, according to certain embodiments, the hydropathic index of amino acids may be considered. Each amino acid has been assigned a hydropathic index on the basis of its hydrophobicity and charge characteristics. They are: isoleucine (+4.5); valine (+4.2); leucine (+3.8); phenylalanine (+2.8); cysteine/cystine (+2.5); methionine (+1.9); alanine (+1.8); glycine (−0.4); threonine (−0.7); serine (−0.8); tryptophan (−0.9); tyrosine (−1.3); proline (−1.6); histidine (−3.2); glutamate (−3.5); glutamine (−3.5); aspartate (−3.5); asparagine (−3.5); lysine (−3.9); and arginine (−4.5).

The importance of the hydropathic amino acid index in conferring interactive biological function on a protein is understood in the art (see, for example, Kyte et al., 1982, *J. Mol. Biol.* 157:105-131). It is known that certain amino acids may be substituted for other amino acids having a similar hydropathic index or score and still retain a similar biological activity. In making changes based upon the hydropathic index, in certain embodiments, the substitution of amino acids whose hydropathic indices are within ±2 is included. In certain embodiments, those that are within ±1 are included, and in certain embodiments, those within ±0.5 are included.

It is also understood in the art that the substitution of like amino acids can be made effectively on the basis of hydrophilicity, particularly where the biologically functional protein or peptide thereby created is intended for use in immunological embodiments, as disclosed herein. In certain embodiments, the greatest local average hydrophilicity of a protein, as governed by the hydrophilicity of its adjacent amino acids, correlates with its immunogenicity and antigenicity, i.e., with a biological property of the protein.

The following hydrophilicity values have been assigned to these amino acid residues: arginine (+3.0); lysine (+3.0); aspartate (+3.0±1); glutamate (+3.0±1); serine (+0.3); asparagine (+0.2); glutamine (+0.2); glycine (0); threonine (−0.4); proline (−0.5±1); alanine (−0.5); histidine (−0.5); cysteine (−1.0); methionine (−1.3); valine (−1.5); leucine (−1.8); isoleucine (−1.8); tyrosine (−2.3); phenylalanine (−2.5) and tryptophan (−3.4). In making changes based upon similar hydrophilicity values, in certain embodiments, the substitution of amino acids whose hydrophilicity values are within ±2 is included, in certain embodiments, those that are within ±1 are included, and in certain embodiments, those within ±0.5 are included. One may also identify epitopes from primary amino acid sequences on the basis of hydrophilicity. These regions are also referred to as "epitopic core regions."

Examples of conservative substitutions include the substitution of one non-polar (hydrophobic) amino acid residue such as isoleucine, valine, leucine norleucine, alanine, or methionine for another, the substitution of one polar (hydrophilic) amino acid residue for another such as between arginine and lysine, between glutamine and asparagine, between glycine and serine, the substitution of one basic amino acid residue such as lysine, arginine or histidine for another, or the substitution of one acidic residue, such as aspartic acid or glutamic acid for another. The phrase "conservative amino acid substitution" also includes the use of a chemically derivatized residue in place of a non-derivatized residue, provided that such polypeptide displays the requisite $CGRP_1$ receptor antagonist activity. Other exemplary amino acid substitutions that can be useful in accordance with the present invention are set forth in Table 2.

TABLE 2

Some Useful Amino Acid Substitutions.

| Original Residues | Exemplary Substitutions |
|---|---|
| Ala | Val, Leu, Ile |
| Arg | Lys, Gln, Asn |
| Asn | Gln |
| Asp | Glu |
| Cys | Ser, Ala |
| Gln | Asn |
| Glu | Asp |
| Gly | Pro, Ala |
| His | Asn, Gln, Lys, Arg |
| Ile | Leu, Val, Met, Ala, Phe, Norleucine |
| Leu | Norleucine, Ile, Val, Met, Ala, Phe |
| Lys | Arg, 1,4-Diaminobutyric Acid, Gln, Asn |
| Met | Leu, Phe, Ile |
| Phe | Leu, Val, Ile, Ala, Tyr |
| Pro | Ala |
| Ser | Thr, Ala, Cys |
| Thr | Ser |
| Trp | Tyr, Phe |
| Tyr | Trp, Phe, Thr, Ser |
| Val | Ile, Met, Leu, Phe, Ala, Norleucine |

As stated herein above, in accordance with the present invention, the peptide can also be chemically derivatized at one or more amino acid residues. Peptides that contain derivatized amino acid residues can be synthesized by known organic chemistry techniques. "Chemical derivative" or "chemically derivatized" refers to a subject peptide having one or more residues chemically derivatized by reaction of a functional side group. Such derivatized molecules include, for example, those molecules in which free amino groups have been derivatized to form amine hydrochlorides, p-toluene sulfonyl groups, carbobenzoxy groups, t-butyloxycarbonyl groups, chloroacetyl groups or formyl groups. Free carboxyl groups may be derivatized to form salts, methyl and ethyl esters or other types of esters or hydrazides. Free hydroxyl groups may be derivatized to form O-acyl or O-alkyl derivatives. The imidazole nitrogen of histidine may be derivatized to form N-im-benzylhistidine. Also included as chemical derivatives are those peptides which contain one or more naturally occurring amino acid derivatives of the twenty canonical amino acids, whether in L- or D-form. For example, 4-hydroxyproline may be substituted for proline; 5-hydroxylysine maybe substituted for lysine; 3-methylhistidine may be substituted for histidine; homoserine may be substituted for serine; and ornithine may be substituted for lysine.

Useful derivatizations include, in some embodiments, those in which the amino terminal of the peptide is chemically blocked so that conjugation with the vehicle will be prevented from taking place at an N-terminal free amino group. There may also be other beneficial effects of such a modification, for example a reduction in the CGRP peptide's susceptibility to enzymatic proteolysis. The N-terminus can be acylated or modified to a substituted amine, or derivatized with another functional group, such as an aromatic moiety (e.g., an indole acid, benzyl (Bzl or Bn), dibenzyl (DiBzl or $Bn_2$), or benzyloxycarbonyl (Cbz or Z)), N,N-dimethylglycine or creatine. For example, in some embodiments, an acyl moiety, such as, but not limited to, a formyl, acetyl (Ac), propanoyl, butanyl, heptanyl, hexanoyl, octanoyl, or nonanoyl, can be covalently linked to the N-terminal end of the peptide, which can prevent undesired side reactions during conjugation of the vehicle to the peptide. Other exemplary N-terminal derivative groups include —NRR¹ (other than —NH₂), —NRC(O)R¹, —NRC(O)OR¹, —NRS(O)₂R¹, —NHC(O)NHR¹, succinimide, or benzyloxycarbonyl-NH— (Cbz-NH—), wherein R and R¹ are each independently hydrogen or lower alkyl and wherein the phenyl ring may be substituted with 1 to 3 substituents selected from C₁-C₄ alkyl, C₁-C₄ alkoxy, chloro, and bromo.

In some embodiments, one or more peptidyl [—C(O)NR—] linkages (bonds) between amino acid residues can be replaced by a non-peptidyl linkage. Exemplary non-peptidyl linkages are —CH₂-carbamate [—CH₂—OC(O)NR—], phosphonate, —CH₂— sulfonamide [—CH₂—S(O)₂NR—], urea [—NHC(O)NH—], —CH₂-secondary amine, and alkylated peptide [—C(O)NR⁶— wherein R⁶ is lower alkyl].

In some embodiments, one or more individual amino acid residues can be derivatized. Various derivatizing agents are known to react specifically with selected sidechains or terminal residues, as described in detail below by way of example.

Lysinyl residues and amino terminal residues may be reacted with succinic or other carboxylic acid anhydrides, which reverse the charge of the lysinyl residues. Other suitable reagents for derivatizing alpha-amino-containing residues include imidoesters such as methyl picolinimidate; pyridoxal phosphate; pyridoxal; chloroborohydride; trinitrobenzenesulfonic acid; O-methylisourea; 2,4 pentanedione; and transaminase-catalyzed reaction with glyoxylate.

Arginyl residues may be modified by reaction with any one or combination of several conventional reagents, including phenylglyoxal, 2,3-butanedione, 1,2-cyclohexanedione, and ninhydrin. Derivatization of arginyl residues requires that the reaction be performed in alkaline conditions because of the high pKa of the guanidine functional group. Furthermore, these reagents may react with the groups of lysine as well as the arginine epsilon-amino group.

Specific modification of tyrosyl residues has been studied extensively, with particular interest in introducing spectral labels into tyrosyl residues by reaction with aromatic diazonium compounds or tetranitromethane. Most commonly, N-acetylimidizole and tetranitromethane are used to form O-acetyl tyrosyl species and 3-nitro derivatives, respectively.

Carboxyl sidechain groups (aspartyl or glutamyl) may be selectively modified by reaction with carbodiimides (R'—N=C=N—R') such as 1-cyclohexyl-3-(2-morpholinyl-(4-ethyl)carbodiimide or 1-ethyl-3-(4-azonia-4,4-dimethylpentyl)carbodiimide. Furthermore, aspartyl and glutamyl residues may be converted to asparaginyl and glutaminyl residues by reaction with ammonium ions.

Glutaminyl and asparaginyl residues may be deamidated to the corresponding glutamyl and aspartyl residues. Alternatively, these residues are deamidated under mildly acidic conditions. Either form of these residues falls within the scope of this invention.

Cysteinyl residues can be replaced by amino acid residues or other moieties either to eliminate disulfide bonding or, conversely, to stabilize cross-linking. (See, e.g., Bhatnagar et al., J. Med. Chem., 39:3814-3819 (1996)).

Derivatization with bifunctional agents is useful for cross-linking the peptides or their functional derivatives to a water-insoluble support matrix, if desired, or to other macromolecular vehicles. Commonly used cross-linking agents include, e.g., 1,1-bis(diazoacetyl)-2-phenylethane, glutaraldehyde, N-hydroxysuccinimide esters, for example, esters with 4-azidosalicylic acid, homobifunctional imidoesters, including disuccinimidyl esters such as 3,3'-dithiobis(succinimidylpropionate), and bifunctional maleimides such as bis-N-maleimido-1,8-octane. Derivatizing agents such as methyl-3-[(p-azidophenyl)dithio]propioimidate yield photoactivatable intermediates that are capable of forming crosslinks in the presence of light. Alternatively, reactive water-insoluble matrices such as cyanogen bromide-activated carbohydrates and the reactive substrates, e.g., as described in U.S. Pat. Nos. 3,969,287; 3,691,016; 4,195,128; 4,247,642; 4,229,537; and 4,330,440, are employed for protein immobilization.

Other possible modifications include hydroxylation of proline and lysine, phosphorylation of hydroxyl groups of seryl or threonyl residues, oxidation of the sulfur atom in Cys, methylation of the alpha-amino groups of lysine, arginine, and histidine side chains. Creighton, Proteins: Structure and Molecule Properties (W. H. Freeman & Co., San Francisco), 79-86 (1983).

The above examples of derivatizations are not intended to be an exhaustive treatment, but merely illustrative.

Some exemplary embodiments of the inventive composition of matter include vehicle-conjugated, or unconjugated, CGRP peptide antagonists in which the amino acid sequence of the CGRP peptide contains (a) any of SEQ ID NOS: 47 through 55 and 82 through 127, herein below:

```
                                                 (SEQ ID NO: 47)
VTHRLAGLLSRSGGVVKNNFVPTDVGPFAF-NH₂, (SEQ ID NO: 48)
VTHRLAGLLSRSGGVKRNNFVPTDVGPFAF-NH₂, (SEQ ID NO: 49)
VTHRLAGLLSRSGGVVKNNFVPTDVGPFAF-NH₂, (SEQ ID NO: 50)
VTHRLAGLLSRSGGVVRKNFVPTDVGPFAF-NH₂, (SEQ ID NO: 51)
VTHRLAGLLSRSGGVVRNKFVPTDVGPFAF-NH₂, (SEQ ID NO: 52)
VTHRLAGLLSRSGGVCRNNFVPTDVGPFAF-NH₂, (SEQ ID NO: 53)
VTHRLAGLLSRSGGVVCNNFVPTDVGPFAF-NH₂, (SEQ ID NO: 54)
VTHRLAGLLSRSGGVVRCNFVPTDVGPFAF-NH₂, (SEQ ID NO: 55)
VTHRLAGLLSRSGGVVRNCFVPTDVGPFAF-NH₂;

(SEQ ID NO: 82)
VTH[hCit]LAGLLS[hCit]SGGVVRKNFVPTDVGPFAF-NH₂;

(SEQ ID NO: 83)
VTH[hK]LAGLLS[hK]SGGVVRKNFVPTDVGPFAF-NH₂;

(SEQ ID NO: 84)
VTH[NMeR]LAGLLS[NMeR]SGGVVRKNFVPTDVGPFAF-NH₂;

(SEQ ID NO: 85)
VTH[NMeR]LAGLLS[NMeR]SGGVV[NMeR]KNFVPTDVGPFAF-NH₂;

(SEQ ID NO: 86)
VTH[Cit][NMeL]AGLLS[Cit]SGGVVRKNFVPTDVGPFAF-NH₂;

(SEQ ID NO: 87)
VTH[Cit][Nle]AG[Nle][Nle]S[Cit]SGGVVRKNFVPTDVGPFA
F-NH₂;
```

VTH[Cit][Nva]AG[Nva][Nva]S[Cit]SGGVVRKNFVPTDVGPFAF-NH₂; (SEQ ID NO: 88)

VT[Tic][Cit]LAGLLS[Cit]SGGVVRKNFVPTDVGPFAF-NH₂; (SEQ ID NO: 89)

VTH[Cit]LAGLLT[Cit]SGGVVRKNFVPTDVGPFAF-NH₂; (SEQ ID NO: 90)

VTH[Cit]LA[Sar]LLS[Cit]SGGVVRKNFVPTDVGPFAF-NH₂; (SEQ ID NO: 91)

VTH[Cit][Nle]AG[Nle][Nle]T[Cit]SGGVV[hR]KNFVPTDV[Sar]PFAF-NH₂; (SEQ ID NO: 92)

VTH[hCit][Nle]AG[Nle][Nle]T[hCit]SGGVV[hR]KNFVPTDV[Sar]PFAF-NH₂; (SEQ ID NO: 93)

VTH[NMeR][Nle]AG[Nle][Nle]T[NMeR]SGGVV[NMeR]KNFVPTDV[Sar]PFAF-NH₂; (SEQ ID NO: 94)

VTH[NMeR][Nva]AG[Nva][Nva]T[NMeR]SGGVV[NMeR]KNFVPTDV[Sar]PFAF-NH₂; (SEQ ID NO: 95)

WVTHRLAGLASRPGGVVRKNFVPTDVGPFAF-NH₂; (SEQ ID NO: 1128)

VTH[Cit]LAGLASRPGGVVRKNFVPTDVGPFAF-NH₂; (SEQ ID NO: 1129)

VTH[Cit]LAGLLSRPGGVVRKNFVPTDVGPFAF-NH₂; (SEQ ID NO: 98)

VTH[Cit]LAGLLPRSGGVVRKNFVPTDVGPFAF-NH₂; (SEQ ID NO: 99)

VTHRLAGLLPRSGGVVRKNFVPTDVGPFAF-NH₂; (SEQ ID NO: 100)

VTHQLAGLLSQSGGVV[hArg]KNFVPTDVGPFAF-NH₂; (SEQ ID NO: 101)

VTH[Cit]LAGLLS[Cit]SGGVV[hArg]KNFVPTDVGPFAF-NH₂; (SEQ ID NO: 102)

VTHRLAGLLSRSGGVVR[4AmP]NFVPTDVGPFAF-NH₂; (SEQ ID NO: 103)

VEH[hArg]LKGLLS[Cit]SGGVVRKNFVPTDVGPFAF-NH₂; (SEQ ID NO: 104)

[1-Nal]VEH[hArg]LKGLLS[Cit]SGGVVRKNFVPTDVGPFAF-NH₂; (SEQ ID NO: 105)

Ac-[Aib]WVEH[hArg]LKGLLS[Cit]SGGVVRKNFVPTDVGPFAF-NH₂; (SEQ ID NO: 106)

VTH[Cit]LAGLLS[Cit]SGGVVRKNFVPTDVGPFAF-NH₂; (SEQ ID NO: 107)

VTH[hCit]LAGLLS[hCit]SGGVV[hArg]KNFVPTDVGPFAF-NH₂; (SEQ ID NO: 108)

VTH[hArg]LAGLLS[hCit]SGGVV[hArg]KNFVPTDVGPFAF-NH₂; (SEQ ID NO: 109)

VTH[hArg]LAGLLS[Cit]SGGVV[hArg]KNFVPTDVGPFAF-NH₂; (SEQ ID NO: 110)

VTH[hArg]LAGLLS[hArg]SGGVV[hArg]KNFVPTDVGPFAF-NH₂; (SEQ ID NO: 111)

VTHQLAGLLS[Cit]SGGVVR[hArg]KNFVPTDVGPFAF-NH₂; (SEQ ID NO: 112)

VTH[Cit]LAGLLSQSGGVVR[hArg]KNFVPTDVGPFAF-NH₂; (SEQ ID NO: 113)

VTH[Cit]LAGLLS[hArg]SGGVVR[hArg]KNFVPTDVGPFAF-NH₂; (SEQ ID NO: 114)

VTH[hCit]LAGLLS[hArg]SGGVVR[hArg]KNFVPTDVGPFAF-NH₂; (SEQ ID NO: 115)

VEHRLKGLLS[Cit]SGGVVR[hArg]KNFVPTDVGPFAF-NH₂; (SEQ ID NO: 116)

VEH[Cit]LKGLLS[Cit]SGGVVR[hArg]KNFVPTDVGPFAF-NH₂; (SEQ ID NO: 117)

VEHRLKGLLS[hArg]SGGVVR[hArg]KNFVPTDVGPFAF-NH₂; (SEQ ID NO: 118)

VEHRLKGLLSQSGGVVR[hArg]KNFVPTDVGPFAF-NH₂; (SEQ ID NO: 119)

VTH[Cit]LAGLLS[Cit]SGGVV[hArg]KNFVPTDVGPFAF-NH₂; (SEQ ID NO: 120)

VTH[Cit]LAGLLS[Cit]SGGVV[hArg]KNFVPTDVG[Oic]FAF-NH₂; (SEQ ID NO: 121)

VTH[Cit]LAGLLS[Cit]SGGVV[hArg]KNFVPTDVGP[1-Nal]AF-NH₂; (SEQ ID NO: 122)

VTH[Cit]LAGLLS[Cit]SGGVV[Guf]KNFVPTDVGPFAF-NH₂; (SEQ ID NO: 123)

VTH[Cit]LAGLLS[Cit]SGGVV[hArg]KNFVPTDVGP[Bip]AF-NH₂; (SEQ ID NO: 124)

VTH[hArg]LAGLLS[Cit]SGGVV[hArg]KNFVPTDVGP[2-Nal]AF-NH₂; (SEQ ID NO: 125)

VTH[Cit]LAGLLS[Cit]SGGVV[hArg]KNFVPTDVGP[Igl]AF-NH₂); (SEQ ID NO: 126)
or

VTH[Cit]LAGLLS[Cit]SGGVV[hArg]KN[pI-Phe]VPTDVGP[pI-Phe]AF-NH₂; (SEQ ID NO: 127)
or (b) an N-terminal truncation of any of (a) that preserves the hinge region and the first CGRP₁ receptor binding region, for example, but not limited to, a sequence having an N-terminal truncation of 1, 2, 3, 4, 5, 6, 7, 8, 9, 10, 11, 12, 13, 14, 15, 16, 17, 18, 19, or about 20 contiguous amino acid residues; or (c) any of (a) or (b), in which the amino acid sequence further contains an aromatic amino acid residue at the N-terminal end; or (d) any of (a), (b), or (c), in which the amino acid sequence contains a modification relative to the native human αCGRP reference sequence that eliminates a protease binding site or cleavage site. As described herein, some embodiments of the peptides described in (a), (b), (c), or (d) are usefully N-terminally acylated or otherwise derivatized with another functional group as described herein.

Some embodiments of the inventive composition of matter involve a CGRP peptide antagonist that comprises CGRP peptide that having an amino acid sequence of the formula:

(SEQ ID NO: 1127)
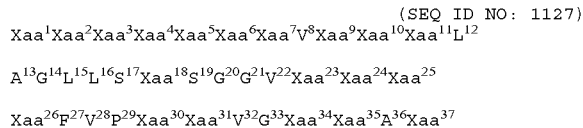

wherein:

$Xaa^1$, $Xaa^2$, $Xaa^3$ $Xaa^4$, $Xaa^5$, $Xaa^6$, and $Xaa^7$, are each independently absent or a hydrophobic amino acid residue;

$Xaa^7$ is a hydrophobic amino acid residue (e.g., Trp, 1-Nal, 2-Nal, Phe, Tyr, or Bip);

$Xaa^9$ is a neutral hydrophobic or neutral polar residue (e.g., Thr, Ser, Ala, Gly, Val, Leu, or Ile);

$Xaa^{10}$ is a basic amino acid residue (e.g., His, $N^\alpha$-Methyl-His);

$Xaa^{11}$ is a basic amino acid residue (e.g., a basic $N^\alpha$-substituted amino acid residue, Arg, $N^\alpha$-Methyl-Arg; homoarginine, Cit, $N^\alpha$-Methyl-Cit, Homocitrulline, His, Guf, and 4-Amino-Phe);

$Xaa^{18}$ is a basic amino acid residue (e.g., a basic $N^\alpha$-substituted amino acid residue, Arg, $N^\alpha$-Methyl-Arg; homoarginine, Cit, $N^\alpha$-Methyl-Cit, Homocitrulline, His, Guf and 4-Amino-Phe);

$Xaa^{23}$ is a neutral amino acid residue or a basic amino acid residue (e.g., Val, Arg, D-Arg, homoarginine, Lys, D-Lys, homolysine, Orn, Dab, Dpr, homocysteine, and 4-Amino-Phe);

$Xaa^{24}$ is a neutral amino acid residue or a basic amino acid residue (e.g., Arg, D-Arg, homoarginine, Lys, D-Lys, homolysine, Orn, Dab, Dpr, Homocysteine, and 4-Amino-Phe);

$Xaa^{25}$ is a neutral amino acid residue or a basic amino acid residue (e.g., Arg, D-Arg, Lys, D-Lys, homolysine, Orn, Dab, Dpr, Cys, homocysteine, and 4-Amino-Phe);

$Xaa^{26}$ is a neutral amino acid residue or a basic amino acid residue (e.g., Arg, D-Arg, Asn, Lys, D-Lys, homolysine, Orn, Dab, Dpr, Cys, homocysteine, and 4-Amino-Phe);

$Xaa^{30}$ is a neutral polar amino acid residue (e.g., Thr, $N^\alpha$-Methyl-Thr, Ser, N-Methyl-Ser);

$Xaa^{34}$ is a cyclic amino acid residue, a neutral hydrophobic amino acid residue, or a neutral polar amino acid residue (e.g., Oic, Pro, Hyp, Tic, D-Tic, D-Pro, Thz, Aib, Sar, and Pip);

$Xaa^{35}$ is a neutral hydrophobic or aromatic amino acid residue (e.g., Phe, D-Phe, Tyr, 1-Nal, 2-Nal, Trp, Bip); and $Xaa^{37}$ is a neutral hydrophobic or aromatic amino acid residue (e.g., Phe, Tyr, 1-Nal, 2-Nal, Trp, and Bip).

In some preferred embodiments, the composition of matter includes at its N-terminal an acyl, acetyl (Ac), benzoyl, benzyloxycarbonyl (Cbz or Z), benzyl (Bzl), or dibenzyl (DiBzl or $Bn_2$) moiety. In some embodiments, the CGRP peptide is conjugated to a polyethylene glycol (PEG) at:

(a) 1, 2, 3 or 4 amino functionalized sites of the PEG;
(b) 1, 2, 3 or 4 thiol functionalized sites of the PEG;
(c) 1, 2, 3 or 4 maleimido functionalized sites of the PEG;
(d) 1, 2, 3 or 4 N-succinimidyl functionalized sites of the PEG;
(e) 1, 2, 3 or 4 carboxyl functionalized sites of the PEG; or
(f) 1, 2, 3 or 4 p-nitrophenyloxycarbonyl functionalized sites of the PEG.

Some other embodiments of the inventive composition of matter incorporate cyclizations to improve stability at residues implicated in proteolytic degradation and/or to improve functional activity of the CGRP peptide antagonist. Some of these contain a CGRP peptide that comprises an amino acid sequence of the formula:

(SEQ ID NO: 1130)
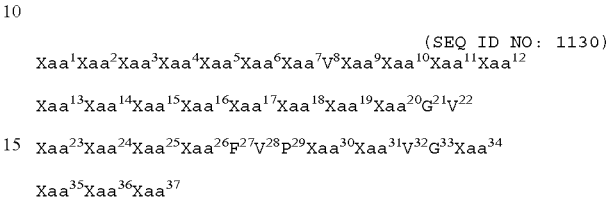

wherein:

$Xaa^1$, $Xaa^2$, $Xaa^3$, $Xaa^4$, $Xaa^5$, $Xaa^6$, and $Xaa^7$, are each independently absent or a hydrophobic amino acid residue;

$Xaa^7$ is a hydrophobic amino acid residue (e.g., Trp, 1-Nal, 2-Nal, Phe, Tyr, Bip, 4-carboxy-phenylalanine, 4-Amino-Phe);

$Xaa^9$ is a neutral hydrophobic or neutral polar residue (e.g., Thr, Ser, Ala, Gly, Val, Leu, Ile);

$Xaa^{10}$ is a basic amino acid residue (e.g., His, $N^\alpha$-Methyl-His, Lys, Homolysine, Ornithine, 4 Amino-Phe);

$Xaa^{11}$ is a basic amino acid residue (e.g., Arg, $N^\alpha$-Methyl-Arg, homoarginine, Cit, $N^\alpha$-Methyl-Cit, Homocitrulline, His, Guf; Lys, Homolysine, Ornithine, 4 Amino-Phe);

$Xaa^{12}$ is Leu, Lys, Homolysine. Ornithine, 4-carboxy-phenylalanine, 4-Amino-Phe, beta-glutamic acid, beta-Homoglutamic acid, homoglutamic acid, or Asp;

$Xaa^{13}$ is Ala, Lys, Homolysine, Ornithine, 4-carboxy-phenylalanine, 4-Amino-Phe, beta-glutamic acid, beta-Homoglutamic acid, homoglutamic acid, or Asp;

$Xaa^{14}$ is Gly, Lys, Homolysine, Ornithine, 4-carboxy-phenylalanine, 4-Amino-Phe, beta-glutamic acid, beta-Homoglutamic acid, homoglutamic acid, or Asp;

$Xaa^{15}$ is Leu, Lys, Homolysine, Ornithine, 4-carboxy-phenylalanine, 4-Amino-Phe, beta-glutamic acid, beta-Homoglutamic acid, homoglutamic acid, or Asp;

$Xaa^{16}$ is Leu, Lys, Homolysine, Ornithine, 4-carboxy-phenylalanine, 4-Amino-Phe, beta-glutamic acid, beta-Homoglutamic acid, homoglutamic acid, or Asp;

$Xaa^{17}$ is Ser, Lys, Homolysine, Ornithine, 4-carboxy-phenylalanine, 4-Amino-Phe, beta-glutamic acid, beta-Homoglutamic acid, homoglutamic acid, or Asp;

$Xaa^{18}$ is a basic amino acid residue (e.g., Arg, $N^\alpha$-Methyl-Arg, homoarginine, Cit, $N^\alpha$-Methyl-Cit, Homocitrulline, His, Guf, Lys, Homolysine, Ornithine, 4 Amino-Phe);

$Xaa^{19}$ is Ser, Lys, Homolysine, Ornithine, 4-carboxy-phenylalanine, 4-Amino-Phe, beta-glutamic acid, beta-Homoglutamic acid, homoglutamic acid, or Asp;

$Xaa^{20}$ is Gly, Lys, Homolysine, Ornithine, 4-carboxy-phenylalanine, 4-Amino-Phe, beta-glutamic acid, beta-Homoglutamic acid, homoglutamic acid, or Asp;

$Xaa^{23}$ is a neutral amino acid residue or a basic amino acid residue (e.g., Val, Arg, D-Arg, Homoarginine, Lys, D-Lys, Homolysine, Orn, Dab, Dpr, Homocysteine, or 4-Amino-Phe);

$Xaa^{24}$ is a neutral amino acid residue or a basic amino acid residue (e.g., Arg, D-Arg, Homoarginine, Lys, D-Lys, Homolysine, Orn, Dab, Dpr, Homocysteine, or 4-Amino-Phe);

Xaa²⁵ is a neutral amino acid residue or a basic amino acid residue (e.g., Lys, D-Lys, Homolysine, Orn, Dab, Dpr, Cys, Homocysteine, 4-Amino-Phe, Arg, or D-Arg);

Xaa²⁶ is a neutral amino acid residue or a basic amino acid residue (e.g., Asn, Lys, D-Lys, Homolysine, Orn, Dab, Dpr, Cys, Homocysteine, 4-Amino-Phe, Arg, or D-Arg);

Xaa³⁰ is a neutral polar amino acid residue (e.g., Thr, N-Methyl-Thr, Ser, N-Methyl-Ser);

Xaa³¹ is Asn, Lys, Homolysine, Ornithine, 4-carboxy-phenylalanine, 4-Amino-Phe, beta-glutamic acid, beta-Homoglutamic acid, homoglutamic acid, or Asp;

Xaa³² is Val, Lys, Homolysine, Ornithine, 4-carboxy-phenylalanine, 4-Amino-Phe, beta-glutamic acid, beta-Homoglutamic acid, homoglutamic acid, or Asp;

Xaa³³ is Gly, Lys, Homolysine, Ornithine, 4-carboxy-phenylalanine, 4-Amino-Phe, beta-glutamic acid, beta-Homoglutamic acid, homoglutamic acid, or Asp;

Xaa³⁴ is a cyclic amino acid residue, a neutral hydrophobic amino acid residue, or a neutral polar amino acid residue (e.g., Oic, Pro, Hyp, Tic, D-Tic, D-Pro, Thz, Aib, Sar, Pip);

Xaa³⁵ is a neutral hydrophobic or aromatic amino acid residue (e.g., Phe, D-Phe, Tyr, 1-Nal, 2-Nal, Trp, Bip, 4 carboxy-phenylalanine, 4-Amino-Phe); Xaa³⁶ is Ala, Lys, Homolysine, Ornithine, 4-carboxy-phenylalanine, 4-Amino-Phe, beta-glutamic acid, beta-Homoglutamic acid, homoglutamic acid, or Asp; Xaa³⁷ is a neutral hydrophobic or aromatic amino acid residue (e.g., Phe, Tyr, 1-Nal, 2-Nal, Trp, Bip 4-carboxy-phenylalanine; 4-Amino-Phe); and wherein a first pair (two) of amino acid residues selected from Xaa⁷, Xaa⁸, Xaa⁹, Xaa¹⁰, Xaa¹¹, Xaa¹², Xaa¹³, Xaa¹⁴, Xaa¹⁵, Xaa¹⁶, Xaa¹⁷, Xaa¹⁸, Xaa¹⁹, Xaa²⁰, Xaa³⁰, Xaa³¹, Xaa³², Xaa³³, Xaa³⁴, Xaa³⁵, Xaa³⁶, and Xaa³⁷ are covalently joined to form a first ring and the first pair of amino acid residues forming the first ring are separated by 3 to 7 amino acid residues, more preferably by 3 to 4 amino acid residues, in the CGRP peptide's primary sequence (i.e., the chain. For example, in some embodiments a lactam bridge is formed between residues at positions (relative to the position on the reference SEQ ID NO:43): 7 and 11, or 8 and 12, or 9 and 13, or 10 and 14, or 11 and 15, or 12 and 16, or 13 and 17, or 14 and 18, or 15 and 19, or 16 and 20, or 17 and 21, or 18 and 22, or 19 and 23, or 21 and 25, or 22 and 26, or 26 and 31, or 27 and 32, or 28 and 33, or 30 and 35, or 31 and 36, or 32 and 37. Double cyclizations are also useful in accordance with the present invention. Thus in some embodiments of the composition of matter, a second pair of amino acid residues, both members of which are different from both members of the first pair of amino acid residues, is selected from Xaa⁷, Xaa⁸, Xaa⁹, Xaa¹⁰, Xaa¹¹, Xaa¹², Xaa¹³, Xaa¹⁴, Xaa¹⁵, Xaa¹⁶, Xaa¹⁷, Xaa¹⁸, Xaa¹⁹, Xaa²⁰, Xaa³⁰, Xaa³¹, Xaa³², Xaa³³, Xaa³⁴, Xaa³⁵, Xaa³⁶, and Xaa³⁷, the second pair of amino acid residues being covalently joined to form a second ring. The second pair of amino acid residues forming the second ring are also separated by 3 to 7 amino acid residues, more preferably by 3 to 4 amino acid residues, in the CGRP peptide's primary sequence, and both members of the second pair of amino acid residues are more proximal in the primary sequence to either the C-terminal end or the N-terminal end of the CGRP peptide compared to both members of the first pair of amino acid residues. Inventive cyclized CGRP peptide antagonists include, e.g., those involving two lactam bridges between residues at positions 9 and 13 (a first ring, for example) and between residues at positions 15 and 19 (a second ring, for example) in relative to positions on SEQ ID NO:43. Inventive cyclized CGRP peptide antagonists also include CGRP peptides comprising the amino acid primary sequence of any of SEQ ID NOS: 155 through 157, 167 through 170, 180 through 228, 242 through 280, 348 through 406, 416 through 430, 439 through 498, 512 through 566, 580 through 634, 889 through 911, 942 through 944, 987, 988, 994 through 996, and 1063 through 1083, whether or not shown in unconjugated or vehicle-conjugated form.

In some preferred embodiments of these inventive compositions containing cyclized CGRP peptides, the composition of matter includes at its N-terminal an acyl, acetyl (Ac), benzoyl, benzyloxycarbonyl (Cbz or Z), benzyl (Bzl or Bn), or dibenzyl (DiBzl or Bn₂) moiety. In some embodiments, the CGRP peptide is conjugated to a polyethylene glycol (PEG) at:

(a) 1, 2, 3 or 4 amino functionalized sites of the PEG;
(b) 1, 2, 3 or 4 thiol functionalized sites of the PEG;
(c) 1, 2, 3 or 4 maleimido functionalized sites of the PEG;
(d) 1, 2, 3 or 4 N-succinimidyl functionalized sites of the PEG;
(e) 1, 2, 3 or 4 carboxyl functionalized sites of the PEG; or
(f) 1, 2, 3 or 4 p-nitrophenyloxycarbonyl functionalized sites of the PEG.

Additional CGRP peptide antagonists that are encompassed within the present invention include any of those comprising an amino acid primary sequence set forth in the following Table 2A, Table 2B, Table 2C, and Table 2D, whether shown in vehicle-conjugated (e.g., PEGylated form) or unconjugated form.

TABLE 2A

Exemplary CGRP peptide sequences. Underlined boldface amino acid residues, if any, indicate cyclization between the first underlined boldface residue and the second underlined boldface residue in a sequence. IC 50 values were determined as describe in Example 1 herein.

| SEQ ID NO | CGRP Peptide Sequence | IC50 (nM) |
|---|---|---|
| 128 | Ac-KWVTH[Cit]LAGLLS[Cit]SGGVVRKNFVPTDVGPKAF-NH2 | 12.98 |
| 129 | Ac-WVTH[Cit]LAGELS[Cit]KGGW[hArg]KNFVPTDVG[Oic]FAF-NH2 | 1.33 |
| 130 | Ac-WVTH[Cit]LAGLLS[Cit]SGGVV[hArg]KNFVPTDVG[Tic]FAF-NH2 | 2.47 |
| 131 | Ac-WVTH[Cit]LAGLLS[Cit]SGGVV[hArg]KNFVPTDVGP[Tic]AF-NH2 | 89.91 |
| 132 | Ac-WVTH[Cit]LAGLLS[Cit]SGGVV[hArg]KNFV[Oic]TDVG[Oic]FA[2-Nal]-NH2 | 2.57 |
| 133 | Ac-WVTH[Cit]LAGLLS[Cit]SGGVV[hArg]KNFV[Oic]TDVGP[1-Nal]A[2-Nal]-NH2 | 2.73 |

TABLE 2A-continued

Exemplary CGRP peptide sequences. Underlined boldface amino acid residues, if any, indicate cyclization between the first underlined boldface residue and the second underlined boldface residue in a sequence. IC 50 values were determined as describe in Example 1 herein.

| SEQ ID NO | CGRP Peptide Sequence | IC50 (nM) |
|---|---|---|
| 134 | Ac-WVTH[Cit]LAGLLS[Cit]SGGVV[hArg]KNFV[Oic]TDVGP[Bip]AF-NH2 | 3.85 |
| 135 | Ac-WVTH[Cit]LAGLLS[Cit]SGGVV[hArg]KNFV[Oic]TDVGPFA[2-Nal]-NH2 | 3.22 |
| 136 | Ac-WVTH[Cit]LAGLLS[Cit]SGGVV[hArg]KN[pI-Phe]V[Oic]TDVGP[pI-Phe]AF-NH2 | 2.34 |
| 137 | Ac-WVTH[Cit]LAGLLS[Cit]SGGVV[hArg]KN[2-Nal]VPTDVG[Oic]FAF-NH2 | 2.66 |
| 138 | Ac-WVTH[Cit]LAGLLS[Cit]SGGVV[hArg]KN[2-Nal]VPTDVG[Oic]FA[2-Nal]-NH2 | 3.45 |
| 139 | Ac-WVTH[Cit]LAGLLS[Cit]SGGVV[hArg]KN[2-Nal]V[Oic]TDVG[Oic]FA[2-Nal]-NH2 | 3.57 |
| 140 | Ac-WVTH[Cit]LAGLLS[Cit]SGGVVRKNFVPTDVG[Tic]FAF-NH2 | 3.02 |
| 141 | Ac-WVTH[Cit]LAGLLS[Cit]SGGVVRKNFVPTDVG[Tic]FAF-NH2 | 4.32 |
| 142 | Ac-WVTH[Cit]LAGLLS[Cit]SGGVV[hArg]KNFVPTDVG[Tic]FAF-NH2 | 19.7 |
| 143 | Ac-WVTH[Cit]LAGLLS[Cit]SGGVV[hArg]KNFVPTDVG[Tic]FAF-NH2 | 8.85 |
| 144 | Ac-WVTH[Cit]LAGLLS[Cit]SGGVV[hArg]KNFVPTDVGP[1-Nal]AF-NH2 | 2.24 |
| 145 | Ac-WVTH[Cit]LAGLLS[Cit]SGGVV[hArg]KNFVPTDVG[Oic]FAF-NH2 | 4.04 |
| 146 | Ac-WVTH[Cit]LAGLLS[Cit]SGGVVRKNFVPTDVGP[Tic]AF-NH2 | 10.13 |
| 653 | Ac-WVTH[Cit]LAGLLS[Cit]SGGVV[hArg]KNFVPTDVGPFAF-NH2 | 3.22 |
| 654 | Ac-VVVTH[Cit]LAGLLS[Cit]SGGVV[hArg]KNFVPTDVGPFA-NH2 | >1000 |
| 655 | Ac-WVTH[Cit]LAGLLS[Cit]SGGVV[hArg]KNFVPTDVGPF-NH2 | >1000 |
| 656 | Ac-WVTH[Cit]LAGLLS[Cit]SGGVV[hArg]KNFVPTDVGP-NH2 | >1000 |
| 657 | Ac-[Cit]LAGLLS[Cit]SGGVV[hArg]KNFVPTDVGPFAF-NH2 | 13.03 |
| 658 | Ac-WVTH[Cit]LAGLLS[Cit]SGGVV[hArg]KNFVPTDVG[Oic]FAF-NH2 | 1.04-3.15 |
| 659 | Ac-WVTH[Cit]LAGLLS[Cit]SGGVV[hArg]KNFVPTDVG[Oic]FA-NH2 | >1000 |
| 660 | Ac-VTH[Cit]LAGLLS[Cit]SGGVV[hArg]KNFVPTDVG[Oic]FAF-NH2 | 3 |
| 661 | Ac-[Cit]LAGLLS[Cit]SGGVV[hArg]KNFVPTDVG[Oic]FAF-NH2 | 8.739 |
| 662 | Ac-LAGLLS[Cit]SGGVV[hArg]KNFVPTDVG[Oic]FAF-NH2 | 16.48 |
| 663 | Ac-WVEHRLKGLLS[Cit]SGGVV[hArg]KNFVPTDVGPFAF-NH2 | 1.217-2.057 |
| 664 | Ac-WVTH[Cit]LAGLLS[Cit]SGGVV[Guf]KNFVPTDVG[Oic]FAF-NH2 | 2.29-2.95 |
| 665 | Ac-WVTH[Cit]LAGLLS[Cit]SGGVV[Cit]KNFVPTDVG[Oic]KAF-NH2 | 3.77 |
| 666 | AC-WVTH[Cit]LAGLLS[Cit]SGGVV[hArg]KNFVPTDVG[Pip]FAF-NH2 | 11.21 |
| 667 | Ac-WVTH[Cit]LAGLLS[Cit]SGGVV[hArg]KNFVPTDVG[Hyp]FAF-NH2<br>*Ac-WVTH[Cit]LAGLLS[Cit]SGGVV[hArg]KNFVPTDVG[Hyp]FAF-amide* | 6.62 |
| 668 | AC-WVTH[Cit]LAGLLS[Cit]SGGVV[hArg]KNFVPTDVG[Hyp]FAF-NH2 | 6.01 |
| 669 | Ac-WVTH[Cit]LAGLLS[Cit]SGGVV[hArg]KNFVPTDVG[Aic]FAF-NH2 | 33.19-261.95 |
| 670 | Ac-WVTH[Cit]LAGLLS[Cit]SGGVV[hArg]KNFVPTDVG[Aib]FAF-NH2 | 4.37 |
| 671 | Ac-WVTH[Cit]LAGLLS[Cit]SGGVV[hArg]KNFVPTDVG[Thz]FAF-NH2 | 2.15 |

TABLE 2A-continued

Exemplary CGRP peptide sequences. Underlined boldface amino acid residues, if any, indicate cyclization between the first underlined boldface residue and the second underlined boldface residue in a sequence. IC 50 values were determined as describe in Example 1 herein.

| SEQ ID NO | CGRP Peptide Sequence | IC50 (nM) |
|---|---|---|
| 672 | Ac-WVTH[Cit]LAGLLS[Cit]SGGVV[hArg]KNFVPTDVG[Sar]FAF-NH2 | 3.19-4.42 |
| 673 | Ac-WVTH[Cit]LAGLLS[Cit]SGGVV[hArg]KNFVPTDVG[Tpi]FAF-NH2 | 28.87 |
| 674 | Ac-WVTH[Cit]LAGLLS[Cit]SGGVV[hArg]KNFVPTDVGP[1-Nal]AF-NH2 | 1.31-1.51 |
| 675 | Ac-WVTH[Cit]LAGLLS[Cit]SGGVV[hArg]KNFVPTDVG[Pip][1-Nal]AF-NH2 | 10.78 |
| 676 | Ac-WVTH[Cit]LAGLLS[Cit]SGGVV[hArg]KNFVPTDVGP[Tpi]AF-NH2 | 79.34 |

TABLE 2B

Additional exemplary CGRP peptide sequences. Underlined boldface amino acid residues, if any, indicate covalent cyclization between the first underlined boldface residue and the second underlined boldface residue in a sequence.

| SEQ ID NO | CGRP Peptide Sequence |
|---|---|
| 733 | Ac-WVTHRLAGLASRPGGVVRKNFVPTDVGPFAF-NH2 |
| 734 | Ac-WVTH[Cit]LAGLASRPGGVVRKNFVPTDVGPFAF-amide |
| 735 | Ac-WVTH[Cit]LAGLLSRPGGVVRKNFVPTDVGPFAF-NH2 |
| 736 | Ac-WVTH[Cit]LAGLLPRSGGVVRKNFVPTDVGPFAF-NH2 |
| 737 | Ac-WVTHRLAGLLPRSGGVVRKNFVPTDVGPFAF-NH2 |
| 738 | Ac-WVTHQLAGLLSQSGGVV[hArg]KNFVPTDVGPFAF-NH2 |
| 739 | Ac-WVTH[Cit]LAGLLS[Cit]SGGVV[hArg]KNFVPTDVGPFAF-NH2 |
| 740 | Ac-WVTHRLAGLLSRSGGVVR[4AmP]NFVPTDVGPFAF-NH2 |
| 741 | Ac-WVEH[hArg]LKGLLS[Cit]SGGVVRKNFVPTDVGPFAF-NH2 |
| 742 | Ac-[1-Nal]VEH[hArg]LKGLLS[Cit]SGGVVRKNFVPTDVGPFAF-NH2 |
| 743 | Ac-[Aib]-WVEH[hArg]LKGLLS[Cit]SGGVVRKNFVPTDVGPFAF-amide |
| 744 | Ac-WVTH[Cit]LAGLLS[Cit]SGGVVRKNFVPTDVGPFAF-NH2 |
| 745 | Ac-WVTH[hCit]LAGLLS[hCit]SGGVV[hArg]KNFVPTDVGPFAF-NH2 |
| 746 | Ac-WVTH[hArg]LAGLLS[hCit]SGGVV[hArg]KNFVPTDVGPFAF-NH2 |
| 747 | Ac-WVTH[hArg]LAGLLS[Cit]SGGVV[hArg]KNFVPTDVGPFAF-NH2 |
| 748 | Ac-WVTH[hArg]LAGLLS[hArg]SGGVV[hArg]KNFVPTDVGPFAF-NH2 |
| 749 | Ac-WVTHQLAGLLS[Cit]SGGVVR[hArg]KNFVPTDVGPFAF-NH2 |
| 750 | Ac-WVTH[Cit]LAGLLSQSGGVVR[hArg]KNFVPTDVGPFAF-NH2 |
| 751 | Ac-WVTH[Cit]LAGLLS[hArg]SGGVVR[hArg]KNFVPTDVGPFAF-NH2 |
| 752 | Ac-WVTH[hCit]LAGLLS[hArg]SGGVVR[hArg]KNFVPTDVGPFAF-NH2 |
| 753 | Ac-WVEHRLKGLLS[Cit]SGGVVR[hArg]KNFVPTDVGPFAF-NH2 |
| 754 | Ac-WVEH[Cit]LKGLLS[Cit]SGGVVR[hArg]KNFVPTDVGPFAF-NH2 |

TABLE 2B-continued

Additional exemplary CGRP peptide sequences. Underlined boldface amino acid residues, if any, indicate covalent cyclization between the first underlined boldface residue and the second underlined boldface residue in a sequence.

| SEQ ID NO | CGRP Peptide Sequence |
|---|---|
| 755 | Ac-WVEHRLKGLLS[hArg]SGGVVR[hArg]KNFVPTDVGPFAF-NH2 |
| 756 | Ac-WVEHRLKGLLSQSGGVVR[hArg]KNFVPTDVGPFAF-NH2 |
| 757 | Ac-WVTH[Cit]LAGLLS[Cit]SGGVV[hArg]KNFVPTDVGPFAF-NH2 |
| 658 | Ac-WVTH[Cit]LAGLLS[Cit]SGGVV[hArg]KNFVPTDVG[Oic]FAF-NH2 |
| 144 | Ac-WVTH[Cit]LAGLLS[Cit]SGGVV[hArg]KNFVPTDVGP[1-Nal]AF-NH2 |
| 758 | Ac-WVTH[Cit]LAGLLS[Cit]SGGVV[Guf]KNFVPTDVGPFAF-NH2 |
| 759 | Ac-WVTH[Cit]LAGLLS[Cit]SGGVV[hArg]KNFVPTDVGP[Bip]AF-NH2 |
| 760 | Ac-WVTH[hArg]LAGLLS[Cit]SGGVV[hArg]KNFVPTDVGP[2-Nal]AF-NH2 |
| 761 | Ac-WVTH[Cit]LAGLLS[Cit]SGGVV[hArg]KNFVPTDVGP[Igl]AF-NH2 |
| 762 | Ac-WVTH[Cit]LAGLLS[Cit]SGGVV[hArg]KN[pI-Phe]VPTDVGP[pI-Phe]AF-NH2 |
| 763 | Ac-WVTH[Cit]LAGLLS[Cit]SGGVV[hArg]KNFVPTDVGPFAF-NH2 |
| 147 | Ac-WVTHRLAGLASRPGGVVRK$^{(20\ kDa\ MeO-PEG)}$NFVPTDVGPEAF-amide |
| 148 | Ac-WVTH[Cit]LAGLASRPGGVVRK$^{(20\ kDa\ MeO-PEG)}$NFVPTDVGPFAF-amide |
| 149 | Ac-WVTH[Cit]LAGLLSRPGGVVRK$^{(20\ kDa\ MeO-PEG)}$NFVPTDVGPFAF-amide |
| 150 | Ac-WVTH[Cit]LAGLLPRSGGVVRK$^{(20\ kDa\ MeO-PEG)}$NFVPTDVGPFAF-amide |
| 151 | Ac-WVTHRLAGLLPRSGGVVRK$^{(20\ kDa\ MeO-PEG)}$NFVPTDVGPFAF-amide |
| 152 | Ac-WVTHQLAGLLSQSGGVV[hArg]K$^{(20\ kDa\ MeO-PEG)}$NFVPTDVGPFAF-amide |
| 153 | Ac-WVTH[Cit]LAGLLS[Cit]SGGVV[hArg]K$^{(20\ kDa\ MeO-PEG)}$NFVPTDVGPFAF-amide |
| 154 | Ac-WVTHRLAGLLSRSGGVVR[4AmP]$^{(20\ kDa\ MeO-PEG)}$NFVPTDVGPFAF-amide |
| 155 | Ac-WVEH[hArg]LKGLLS[Cit]SGGVVRK$^{(20\ kDa\ MeO-PEG)}$NFVPTDVGPFAF-amide |
| 156 | Ac-[1-Nal]VEH[hArg]LKGLLS[Cit]SGGVVRK$^{(20\ kDa\ MeO-PEG)}$NFVPTDVGPFAF-amide |
| 157 | Ac-[Aib]WVEH[hArg]LKGLLS[Cit]SGGVVRK$^{(20\ kDa\ MeO-PEG)}$NFVPTDVGPFAF-amide |
| 158 | Ac-WVTH[Cit]LAGLLS[Cit]SGGVVRK$^{(20\ kDa\ MeO-PEG)}$NFVPTDVGPFAF-amide |
| 159 | Ac-WVTH[hCit]LAGLLS[hCit]SGGVV[hArg]K$^{(20\ kDa\ MeO-PEG)}$NFVPTDVGPFAF-amide |
| 160 | Ac-WVTH[hArg]LAGLLS]hCit]SGGVV[hArg]K$^{(20\ kDa\ MeO-PEG)}$NFVPTDVGPFAF-amide |
| 161 | Ac-WVTH[hArg]LAGLLS[Cit]SGGVV[hArg]K$^{(20\ kDa\ MeO-PEG)}$NFVPTDVGPFAF-amide |
| 162 | Ac-WVTH[hArg]LAGLLS[hArg]SGGVV[hArg]K$^{(20\ kDa\ MeO-PEG)}$NFVPTDVGPFAF-amide |
| 163 | Ac-WVTHQLAGLLS[Cit]SGGVVR[hArg]K$^{(20\ kDa\ MeO-PEG)}$NFVPTDVGPFAF-amide |
| 164 | Ac-WVTH[Cit]LAGLLSQSGGVVR[hArg]K$^{(20\ kDa\ MeO-PEG)}$NFVPTDVGPFAF-amide |
| 165 | Ac-WVTH[Cit]LAGLLS[hArg]SGGVVR[hArg]K$^{(20\ kDa\ MeO-PEG)}$NFVPTDVGPFAF-amide |
| 166 | Ac-WVTH[hCit]LAGLLS[hArg]SGGVVR[hArg]K$^{(20\ kDa\ MeO-PEG)}$NFVPTDVGPFAF-amide |
| 167 | Ac-WVEHRLKGLLS[Cit]SGGVVR[hArg]K$^{(20\ kDa\ MeO-PEG)}$NFVPTDVGPFAF-amide |
| 168 | Ac-WVEH[Cit]LKGLLS[Cit]SGGVVR[hArg]K$^{(20\ kDa\ MeO-PEG)}$NFVPTDVGPFAF-amide |
| 169 | Ac-WVEHRLKGLLS[hArg]SGGVVR[hArg]K$^{(20\ kDa\ MeO-PEG)}$NFVPTDVGPFAF-amide |
| 170 | Ac-WVEHRLKGLLSQSGGVVR[hArg]K$^{(20\ kDa\ MeO-PEG)}$NFVPTDVGPFAF-amide |
| 171 | Ac-WVTH[Cit]LAGLLS[Cit]SGGVV[hArg]K$^{(20\ kDa\ MeO-PEG)}$NFVPTDVGPFAF-amide |

TABLE 2B-continued

Additional exemplary CGRP peptide sequences. Underlined boldface amino acid residues, if any, indicate covalent cyclization between the first underlined boldface residue and the second underlined boldface residue in a sequence.

SEQ ID NO CGRP Peptide Sequence

172 Ac-WVTH[Cit]LAGLLS[Cit]SGGVV[hArg]K[20 kDa MeO-PEG]NFVPTDVG[Oic]FAF-amide

173 Ac-WVTH[Cit]LAGLLS[Cit]SGGVV[hArg]K[20 kDa MeO-PEG]NFVPTDVGP[1-Nal]AF-amide

174 Ac-WVTH[Cit]LAGLLS[Cit]SGGVV[Guf]K[20 kDa MeO-PEG]NFVPTDVGPFAF-amide

175 Ac-WVTH[Cit]LAGLLS[Cit]SGGVV[hArg]K[20 kDa MeO-PEG]NFVPTDVGP[Bip]AF-amide

176 Ac-WVTH[hArg]LAGLLS[Cit]SGGVV[hArg]K[20 kDa MeO-PEG]NFVPTDVGP[2-Nal]AF-amide 177 Ac-WVTH[Cit]LAGLLS[Cit]SGGVV[hArg]K[20 kDa MeO-PEG]NFVPTDVGP[Igl]AF-amide 178 Ac-WVTH[Cit]LAGLLA[Cit]SGGVV[hArg]K[20 kDa MeO-PEG]N[pI-Phe]VPTDVGP[pI-Phe]AF-amide 179 Ac-WVTH[Cit]LAGLLS[Cit]SGGVV[hArg]K[20 kDa MeO-PEG]NFVPTDVGPFAF-amide 180 Ac-WVEH[Cit]LKGLLS[Cit]SGGVV[hArg]KNFVPTDVG[Oic]FAF-amide 181 Ac-WVEHRLKGLLS[Cit]SGGVV[hArg]KNFVPTDVG[Oic]FAF-amide 182 Ac-WVEH[Cit]LKGLLS[Cit]SGGVV[hArg]KNFVP[NmeThr]DVG[Oic]FAF-amide 183 Ac-WVEHRLKGLLS[Cit]SGGVV[hArg]KNFVP[NmeThr]DVG[Oic]FAF-amide 184 Ac-WVEH[Cit]LKGLLS[Cit]SGGVV[hArg]KNFVPTDVG[Oic]FAF-amide 185 Ac-WVEHRLKGLLS[Cit]SGGVV[hArg]KNFVPTDVG[Oic]FAF-amide 186 Ac-WVEH[Cit]LKGLLS[Cit]SGGVV[hArg]KNFVP[NmeThr]DVG[Oic]FAF-amide 187 Ac-WVEHRLKGLLS[Cit]SGGVV[hArg]KNFVP[NmeThr]DVG[Oic]FAF-amide 188 Ac-WVEH[Cit]LKGLLS[Cit]SGGVV[hArg]KNFVP[NmeThr]DVG[Oic]FA[2-Nal]-amide 189 Ac-WVEH[hArg]LKGLLS[Cit]SGGVV[hArg]KNFVPTDVG[Oic]FAF-amide 190 Ac-WVEHKLKGLLS[Cit]SGGVV[hArg]KNFVPTDVG[Oic]FAF-amide 191 Ac-WVEH[hCit]LKGLLS[Cit]SGGVV[hArg]KNFVP[NmeThr]DVG[Oic]FAF-amide 192 Ac-WVEH[Orn]LKGLLS[Cit]SGGVV[hArg]KNFVP[NmeThr]DVG[Oic]FAF-amide 193 Ac-WVEHHLKGLLS[Cit]SGGVV[hArg]KNFVP[NmeThr]DVG[Oic]FA[2-Nal]-amide 194 Ac-WVDH[Cit]LKGLLS[Cit]SGGVV[hArg]KNFVPTDVG[Oic]FAF-amide 195 Ac-WVDHRLKGLLS[Cit]SGGVV[hArg]KNFVPTDVG[Oic]FAF-amide 196 Ac-WVDH[Cit]LKGLLS[Cit]SGGVV[hArg]KNFVP[NmeThr]DVG[Oic]FAF-amide 197 Ac-WVDHRLKGLLS[Cit]SGGVV[hArg]KNFVP[NmeThr]DVG[Oic]FAF-amide 198 Ac-WVDH[Cit]LKGLLS[Cit]SGGVV[hArg]KNFVP[NmeThr]DVG[Oic]FA[2-Nal]-amide 199 Ac-WVEH[Cit]LKGLLS[Cit]SGGVV[Cit]KNFVPTDVG[Oic]FAF-amide 200 Ac-WVEHRLKGLLS[Cit]SGGVV[Cit]KNFVPTDVG[Oic]FAF-amide 201 Ac-WVEH[Cit]LKGLLS[Cit]SGGVV[Cit]KNFVP[NmeThr]DVG[Oic]FAF-amide 202 Ac-WVEHRLKGLLS[Cit]SGGVV[Cit]KNFVP[NmeThr]DVG[Oic]FAF-amide 203 Ac-WVEH[Cit]LKGLLS[Cit]SGGVV[Cit]KNFVP[NmeThr]DVG[Oic]FA[2-Nal]-amide 204 Ac-WVEH[Cit]LKGLLS[Cit]SGGVV[Guf]KNFVPTDVG[Oic]FAF-amide 205 Ac-WVEHRLKGLLS[Cit]SGGVV[Guf]KNFVPTDVG[Oic]FAF-amide 206 Ac-WVEH[Cit]LKGLLS[Cit]SGGVV[Guf]KNFVP[NmeThr]DVG[Oic]FAF-amide TABLE 2B-continued Additional exemplary CGRP peptide sequences. Underlined boldface amino acid residues, if any, indicate covalent cyclization between the first underlined boldface residue and the second underlined boldface residue in a sequence.

SEQ ID NO CGRP Peptide Sequence

207 Ac-WVEH RLKGLLS[Cit]SGGVV[Guf]KNFVP[NmeThr]DVG[Oic]FAF-amide

208 Ac-WVEH[Cit]LKGLLS[Cit]SGGVV[Guf]KNFVP[NmeThr]DVG[Oic]FA[2-Nal]-amide 209 Ac-WVEH[Cit]LKGLLS[Cit]SGGVV[hArg]KNFVP[NmeThr]DVG[Oic]FAW-amide 210 Ac-WVEH[Cit]LKGLLS[Cit]SGGVV[hArg]KNFVP[NmeThr]DVG[Oic]FAH-amide 211 Ac-WVEH[Cit]LKGLLS[Cit]SGGVV[hArg]KNFVP[NmeThr]DVG[Oic]FA[1-Nal]-amide 212 Ac-WVEH[Cit]LKGLLS[Cit]SGGVV[hArg]KNFVP[NmeThr]DVG[Oic]FA[Bip]-amide 213 Ac-WVEH[Cit]LKGLLS[Cit]SGGVV[hArg]KNFVP[NmeThr]DVG[Oic]FA[Tic]-amide 214 Ac-WVEH[Cit]LKGLLS[Cit]SGGVV[hArg]KNFVP[NmeThr]DVG[Oic]FAY-amide 215 Ac-WVEHRLKGLLS[Cit]SGGVV[hArg]KNFVPTDVG[Oic]FAF-amide 216 Ac-WVEHRLKGLLS[Cit]SGGVV[hArg]KNFVPTDVG[Pip]FAF-amide 217 Ac-WVEHRLKGLLS[Cit]SGGVV[hArg]KNFVPTDVG[Hyp]FAF-amide 218 Ac-WVEHRLKGLLS[Cit]SGGVV[hArg]KNFVPTDVG[Hyp]FAF-amide 219 Ac-WVEHRLKGLLS[Cit]SGGVV[hArg]KNFVPTDVG[Aic]FAF-amide 220 Ac-WVEHRLKGLLS[Cit]SGGVV[hArg]KNFVPTDVG[Aic]FAF-amide 221 Ac-WVEHRLKGLLS[Cit]SGGVV[hArg]KNFVPTDVG[Aib]FAF-amide 222 Ac-WVEHRLKGLLS[Cit]SGGVV[hArg]KNFVPTDVG[Thz]FAF-amide 223 Ac-WVEHRLKGLLS[Cit]SGGVV[hArg]KNFVPTDVG[Sar]FAF-amide 224 Ac-WVEHRLKGLLS[Cit]SGGVV[hArg]KNFVPTDVG[Sar]FAF-amide 225 Ac-WVEHRLKGLLS[Cit]SGGVV[hArg]KNFVPTDVG[Tpi]FAF-amide 226 Ac-WVEHRLKGLLS[Cit]SGGVV[hArg]KNFVPTDVG[Oic]FAF-amide 227 Ac-WVEHRLKGLLS[Cit]SGGVV[hArg]KNFVPTDVG[Pip]FAF-amide 228 Ac-WVEHRLKGLLS[Cit]SGGVV[hArg]KNFVPTDVG[Hyp]FAF-amide 233 Ac-WVTH[Cit]LAGLLS[Cit]SGGVV[hArg]KNFVPTDVG[Aic]FAF-amide 234 Ac-WVTH[Cit]LAGLLS[Cit]SGGVV[hArg]KNFVPTDVG[Aic]FAF-amide 235 Ac-WVTH[Cit]LAGLLS[Cit]SGGVV[hArg]KNFVPTDVG[Aib]FAF-amide 236 Ac-WVTH[Cit]LAGLLS[Cit]SGGVV[hArg]KNFVPTDVG[Thz]FAF-amide 237 Ac-WVTH[Cit]LAGLLS[Cit]SGGVV[hArg]KNFVPTDVG[Sar]FAF-amide 238 Ac-WVTH[Cit]LAGLLS[Cit]SGGVV[hArg]KNFVPTDVG[Sar]FAF-amide 239 Ac-WVTH[Cit]LAGLLS[Cit]SGGVV[hArg]KNFVPTDVG[Tpi]FAF-amide 240 Ac-WVTH[Cit]LAGLLS[Cit]SGGVV[hArg]KNFVPTDVG[Pip]FAF-amide 241 Ac-WVTH[Cit]LAGLLS[Cit]SGGVV[hArg]KNFVPTDVG[Hyp]FAF-amide 242 Ac-WVEHRLKGLLS[Cit]SGGVV[hArg]KNFVP[NmeThr]DVG[Oic]FAF-amide 243 Ac-WVEHRLKGLLS[Cit]SGGVV[hArg]KNFVP[NmeThr]DVG[Pip]FAF-amide 244 Ac-WVEHRLKGLLS[Cit]SGGVV[hArg]KNFVP[NmeThr]DVG[Hyp]FAF-amide 245 Ac-WVEHRLKGLLS[Cit]SGGVV[hArg]KNFVP[NmeThr]DVG[Hyp]FAF-amide 246 Ac-WVEHRLKGLLS[Cit]SGGVV[hArg]KNFVP[NmeThr]DVG[Aic]FAF-amide TABLE 2B-continued Additional exemplary CGRP peptide sequences. Underlined boldface amino acid residues, if any, indicate covalent cyclization between the first underlined boldface residue and the second underlined boldface residue in a sequence.

SEQ ID NO CGRP Peptide Sequence

247 Ac-WVEHRLK**GLLS[Cit]SGGVV[hArg]KNFVP[NmeThr]DVG[Aic]FAF-*amide*

248 Ac-WVEHRLK**GLLS[Cit]SGGVV[hArg]KNFVP[NmeThr]DVG[Aib]FAF-*amide*

249 Ac-WVEHRLK**GLLS[Cit]SGGVV[hArg]KNFVP[NmeThr]DVG[Thz]FAF-*amide*

250 Ac-WVEHRLK**GLLS[Cit]SGGVV[hArg]KNFVP[NmeThr]DVG[Sar]FAF-*amide*

251 Ac-WVEHRLK**GLLS[Cit]SGGVV[hArg]KNFVP[NmeThr]DVG[Sar]FAF-*amide*

252 Ac-WVEHRLK**GLLS[Cit]SGGVV[hArg]KNFVP[NmeThr]DVG[Tpi]FAF-*amide*

253 Ac-WVEHRLK**GLLS[Cit]SGGVV[hArg]KNFVP[NmeThr]DVG[Oic]FAF-*amide*

254 Ac-WVEHRLK**GLLS[Cit]SGGVV[hArg]KNFVP[NmeThr]DVG[Pip]FAF-*amide*

255 Ac-WVEHRLK**GLLS[Cit]SGGVV[hArg]KNFVP[NmeThr]DVG[Hyp]FAF-*amide*

256 Ac-WVEHRLK**GLLS[Cit]SGGVV[hArg]KNFVP[NmeThr]DVG[Oic]FA[1-Nal]-*amide*

257 Ac-WVEHRLK**GLLS[Cit]SGGVV[hArg]KNFVP[NmeThr]DVG[Pip]FAY-*amide*

258 Ac-WVEHRLK**GLLS[Cit]SGGVV[hArg]KNFVP[NmeThr]DVG[Hyp]FAH-*amide*

259 Ac-WVEHRLK**GLLS[Cit]SGGVV[hArg]KNFVP[NmeThr]DVG[Hyp]FA[Bip]-*amide*

260 Ac-WVEHRLK**GLLS[Cit]SGGVV[hArg]KNFVP[NmeThr]DVG[Aic]FA[2-Nal]-*amide*

261 Ac-WVEHRLK**GLLS[Cit]SGGVV[hArg]KNFVP[NmeThr]DVG[Aic]FAW-*amide*

262 Ac-EVTHKLAGLLS[Cit]SGGVV[hArg]KNFVPTDVG[Oic]FAF-*amide*

263 Ac-WETH[Cit]KAGLLS[Cit]SGGVV[hArg]KNFVPTDVG[Oic]FAF-*amide*

264 Ac-WVEH[Cit]LKGLLS[Cit]SGGVV[hArg]KNFVPTDVG[Oic]FAF-*amide*

265 Ac-WVTE[Cit]LAKLLS[Cit]SGGVV[hArg]KNFVPTDVG[Oic]FAF-*amide*

266 Ac-WVTHELAGKLS[Cit]SGGVV[hArg]KNFVPTDVG[Oic]FAF-*amide*

267 Ac-WVTH[Cit]EAGLKS[Cit]SGGVV[hArg]KNFVPTDVG[Oic]FAF-*amide*

268 Ac-WVTH[Cit]LEGLLK[Cit]SGGVV[hArg]KNFVPTDVG[Oic]FAF-*amide*

269 Ac-WVTH[Cit]LAELLSKSGGVV[hArg]KNFVPTDVG[Oic]FAF-*amide*

270 Ac-WVTH[Cit]LAGELS[Cit]KGGVV[hArg]KNFVPTDVG[Oic]FAF-*amide*

271 Ac-WVTH[Cit]LAGLES[Cit]SKGVV[hArg]KNFVPTDVG[Oic]FAF-*amide*

272 Ac-WVTH[Cit]LAGLLE[Cit]SGKVV[hArg]KNFVPTDVG[Oic]FAF-*amide*

273 Ac-WVTH[Cit]LAGLLSESGGKV[hArg]KNFVPTDVG[Oic]FAF-*amide*

274 Ac-WVTH[Cit]LAGLLS[Cit]EGGVK[hArg]KNFVPTDVG[Oic]FAF-*amide*

275 Ac-WVTH[Cit]LAGLLS[Cit]SGGVV[hArg]KKFVPTDVG[Oic]FAF-*amide*

276 Ac-WVTH[Cit]LAGLLS[Cit]SGGVV[hArg]KNKVPTDDG[Oic]FAF-*amide*

277 Ac-WVTH[Cit]LAGLLS[Cit]SGGVV[hArg]KNFKPTDVD[Oic]FAF-*amide*

278 Ac-WVTH[Cit]LAGLLS[Cit]SGGVV[hArg]KNFVPKDVG[Oic]DAF-*amide*

279 Ac-WVTH[Cit]LAGLLS[Cit]SGGVV[hArg]KNFVPTKVG[Oic]FDF-*amide*

280 Ac-WVTH[Cit]LAGLLS[Cit]SGGVV[hArg]KNFVPTDKG[Oic]FAD-*amide*

281 Ac-WVTH[Cit]LAGLLS[Cit]SGGVV[hArg]KNFVPTDVG[BhPro]FAF-*amide*

TABLE 2B-continued

Additional exemplary CGRP peptide sequences. Underlined boldface amino acid residues, if any, indicate covalent cyclization between the first underlined boldface residue and the second underlined boldface residue in a sequence.

| SEQ ID NO | CGRP Peptide Sequence |
|---|---|
| 282 | Ac-WVTH[Cit]LAGLLS[Cit]SGGVV[BhArg]KNFVPTDVG[Oic]FAF-amide |
| 283 | Ac-WVTH[Cit]LAGLLS[Cit]SGGVV[hArg]KNFVPTDVG[Oic][BhPhe]AF-amide |
| 284 | Ac-WVTH[Cit]LAGLLS[Cit]SGGVV[hArg]KN[BhPhe]VPTDVG[Oic]FAF-amide |
| 285 | Ac-WVTH[Cit]LAGLLS[Cit]SGGVV[hArg]KN[AMeF]VPTDVG[Oic]FAF-amide |
| 286 | Ac-WVTH[Cit]LAGLLS[Cit]SGGVV[hArg]KNFVPTDVG[Oic]FA[AMeF]-amide |
| 287 | Ac-WVTH[Cit]LAGLLS[Cit]SGGVV[hArg]KNFVPTDVG[Oic][AMeF]AF-amide |
| 288 | Ac-WVTH[Cit]LAGLLS[Cit]SGGVV[hArg]KN[NMePhe]VPTDVG[Oic]FAF-amide |
| 289 | Ac-WVTH[Cit]LAGLLS[Cit]SGGVV[hArg]KNFVPTDVG[Oic]FA[NMePhe]-amide |
| 290 | Ac-WVTH[Cit]LAGLLS[Cit]SGGVV[hArg]KNFVPTDVG[Oic][NMePhe]AF-amide |
| 291 | Ac-WVTH[Cit]LAGLLS[Cit]SGGVV[hArg]KNFVPTDVG[Nip]FAF-amide |
| 297 | Ac-WVTH[Cit]LAGLLS[Cit]SGGVV[hArg]KNFVPTDVG[Tic]FAF-amide |
| 298 | Ac-WVTH[Cit]LAGLLS[Cit]SGGVV[hArg]KNFVPTDVGP[Tic]AF-amide |
| 299 | Ac-WVTH[Cit]LAGLLS[Cit]SGGVV[hArg]KNFV[Oic]TDVG[Oic]FA[2-Nal]-amide |
| 300 | Ac-WVTH[Cit]LAGLLS[Cit]SGGVV[hArg]KNFV[Oic]TDVGP[1-Nal]A[2-Nal]-amide |
| 301 | Ac-WVTH[Cit]LAGLLS[Cit]SGGVV[hArg]KNFV[Oic]TDVGP[Bip]AF-amide |
| 302 | Ac-WVTH[Cit]LAGLLS[Cit]SGGVV[hArg]KNFV[Oic]TDVGPFA[2-Nal]-amide |
| 303 | Ac-WVTH[Cit]LAGLLS[Cit]SGGVV[hArg]KN[pI-Phe]V[Oic]TDVGP[pI-Phe]AF-amide |
| 304 | Ac-WVTH[Cit]LAGLLS[Cit]SGGVV[hArg]KN[2-Nal]VPTDVG[Oic]FAF-amide |
| 305 | Ac-WVTH[Cit]LAGLLs[Cit]SGGVV[hArg]KN[2-Nal]VPTDVG[Oic]FA[2-Nal]-amide |
| 306 | Ac-WVTH[Cit]LAGLLs[Cit]SGGVV[hArg]KN[2-Nal]V[Oic]TDVG[Oic]FA[2-Nal]-amide |
| 307 | Ac-WVTH[Cit]LAGLLS[Cit]SGGVVRKNFVPTDVG[Tic]FAF-amide |
| 308 | Ac-WVTH[Cit]LAGLLS[Cit]SGGVVRKNFVPTDVG[Tic]FAF-amide |
| 309 | Ac-WVTH[Cit]LAGLLS[Cit]SGGVV[hArg]KNFVPTDVG[Tic]FAF-amide |
| 310 | Ac-WVTH[Cit]LAGLLS[Cit]SGGVV[hArg]KNFVPTDVG[Tic]FAF-amide |
| 311 | Ac-WVTH[Cit]LAGLLS[Cit]SGGVV[hArg]KNFVPTDVGP[1-Nal]AF-amide |
| 312 | Ac-WVTH[Cit]LAGLLS[Cit]SGGVV[hArg]KNFVPTDVG[Oic]FAF-amide |
| 313 | Ac-WVTH[Cit]LAGLLS[Cit]SGGVVRKNFVPTDVGP[Tic]AF-amide |
| 314 | Ac-WVTH[Cit]LAGLLS[Cit]SGGVV[hArg]KNFVPTDVG[Tic]FAF-amide |
| 315 | Ac-WVTH[Cit]LAGLLS[Cit]SGGVV[hArg]KNFVPTDVGP[Tic]AF-amide |
| 316 | Ac-WVTH[Cit]LAGLLS[Cit]SGGVV[hArg]KNFV[Oic]TDVG[Oic]FA[2-Nal]-amide |
| 317 | Ac-WVTH[Cit]LAGLLS[Cit]SGGVV[hArg]KNFV[Oic]TDVGP[1-Nal]A[2-Nal]-amide |
| 318 | Ac-WVTH[Cit]LAGLLS[Cit]SGGVV[hArg]KNFV[Oic]TDVGP[Bip]AF-amide |
| 319 | Ac-WVTHRLAGLLSRSGGVVRKN[2-Nal]VPTDVGPFAF-amide |
| 320 | Ac-WVTHRLAGLLSRSGGVVRKNFVPTDVGPFA[2-Nal]-amide |
| 321 | Ac-WVTHRLAGLLSRSGGVVRKNFVPTDVGPFA[1-Nal]-amide |
| 322 | Ac-WVTHRLAGLLSRSGGVVRKNFVPTDVGSKAF-amide |

TABLE 2B-continued

Additional exemplary CGRP peptide sequences. Underlined boldface amino acid residues, if any, indicate covalent cyclization between the first underlined boldface residue and the second underlined boldface residue in a sequence.

| SEQ ID NO | CGRP Peptide Sequence |
|---|---|
| 323 | C[Ahx]WVTHRLAGLLSRSGGVVRKNFVPTDVGPFAF-*amide* |
| 324 | Ac-WVTHRLAGLLSRSGGVVRKNFVPTDVGPKAF-*amide* |
| 325 | Ac-WVTH[Cit]LAGLLS[Cit]SGGVVRKNFVPTDVGPKAF-*amide* |
| 326 | Ac-WVTH[Cit]LAGLLS[Cit]SGGVVRKNFV[Oic]TDVGPFAF-*amide* |
| 327 | Ac-WVTH[Cit]LAGLLS[Cit]SGGVVRKNFVPTDVG[Oic]FAF-*amide* |
| 328 | Ac-WVTH[Cit]LAGLLS[Cit]SGGVVRKNFV[Oic]TDVG[Oic]FAF-*amide* |
| 329 | Ac-WVTH[Cit]LAGLLS[Cit]SGGVVRKN[pI-Phe]VPTDVGPFA[pI-Phe]-*amide* |
| 330 | Ac-WVTH[Cit]LAGLLS[Cit]SGGVVRKNFVPTDVGPFA[pI-Phe]-*amide* |
| 331 | Ac-WVTH[hArg]LAGLLS[Cit]SGGVV[hArg]KNFVPTDVGP[1-Nal]AF-*amide* |
| 332 | Ac-WVTH[hArg]LAGLLS[Cit]SGGVV[hArg]KNFVPTDVGPFA[Phg]-*amide* |
| 333 | Ac-WVTH[hArg]LAGLLS[Cit]SGGVV[hArg]KNFVPTDVGP[2-Nal]AF-*amide* |
| 334 | Ac-WVTH[Cit]LAGLLS[Cit]SGGVV[hArg]KNFVPTDVGP[1-Nal]AF-*amide* |
| 335 | Ac-WVTH[Cit]LAGLLS[Cit]SGGVV[hArg]KN[pI-Phe]VPTDVGP[pI-Phe]AF-*amide* |
| 336 | Ac-WVTH[Cit]LAGLL S[Cit]SGGVV[hArg]KNFVPTDVGP[Bip]AF-*amide* |
| 337 | Ac-WVTH[Cit]LAGLL S[Cit]SGGVV[hArg]KNFVPTDVGP[Igl]AF-*amide* |
| 338 | Ac-WVTH[Cit]LAGLLS[Cit]SGGVV[hArg]KNFVPTDVG[Oic]FAF-*amide* |
| 339 | Ac-WVTH[Cit]LAGLLS[Cit]SGGVV[hArg]KNFV[Oic]TDVG[Oic]FAF-*amide* |
| 340 | Ac-WVTH[Cit]LAGLL S[Cit]SGGVV[hArg]KNFVPTDVG[Oic][1-Nal]AF-*amide* |
| 341 | Ac-WVTH[Cit]LAGLL S[Cit]SGGVV[hArg]KNFVPTDVG[Oic][2-Nal]AF-*amide* |
| 342 | Ac-WVTH[Cit]LAGLLS[hArg]SGGVV[Guf]KNFVPTDVGPFAF-*amide* |
| 343 | Ac-WVTH[Cit]LAGLLS[hArg]SGGVV[BhArg]KNFVPTDVGPFAF-*amide* |
| 344 | Ac-WVTH[Cit]LAGLLS[Cit]SGGVV[Cit]KNFVPTDVGPFAF-*amide* |
| 345 | Ac-WVTH[Cit]LAGLLS[Cit]SGGVV[3G-Dpr]KNFVPTDVGPFAF-*amide* |
| 346 | Ac-WVTH[Cit]LAGLLS[Cit]SGGVV[Guf]KNFVPTDVGPFAF-*amide* |
| 347 | Ac-WVTH[Cit]LAGLLS[Cit]SGGV[Nle]RKNFVPTDVGPFAF-*amide* |
| 348 | Ac-WVCH[hArg]LCGLLS[Cit]SGGVV[hArg]KNFVPTDVG[Oic]FAF-*amide* |
| 349 | Ac-WVCHKLCGLLS[Cit]SGGVV[hArg]KNFVPTDVG[Oic]FAF-*amide* |
| 350 | Ac-WVCH[hCit]LCGLLS[Cit]SGGVV[hArg]KNFVP[NmeThr]DVG[Oic]FAF-*amide* |
| 351 | Ac-WVCH[Orn]LCGLLS[Cit]SGGVV[hArg]KNFVP[NmeThr]DVG[Oic]FAF-*amide* |
| 352 | Ac-WVCHHLCGLLS[Cit]SGGVV[hArg]KNFVP[NmeThr]DVG[Oic]FA[2-Nal]-*amide* |
| 353 | Ac-WVKH[hArg]LEGLLS[Cit]SGGVV[hArg]KNFVPTDVG[Oic]FAF-*amide* |
| 354 | Ac-WVKHKLEGLLS[Cit]SGGVV[hArg]KNFVPTDVG[Oic]FAF-*amide* |
| 355 | Ac-WVKH[hCit]LEGLLS[Cit]SGGVV[hArg]KNFVP[NmeThr]DVG[Oic]FAF-*amide* |
| 356 | Ac-WVKH[Orn]LEGLLS[Cit]SGGVV[hArg]KNFVP[NmeThr]DVG[Oic]FAF-*amide* |
| 357 | Ac-WVKHHLEGLLS[Cit]SGGVV[hArg]KNFVP[NmeThr]DVG[Oic]FA[2-Nal]-*amide* |

TABLE 2B-continued

Additional exemplary CGRP peptide sequences. Underlined boldface amino acid residues, if any, indicate covalent cyclization between the first underlined boldface residue and the second underlined boldface residue in a sequence.

SEQ ID NO  CGRP Peptide Sequence

358 Ac-WVEH[hArg]LKGLLS[Cit]SGGVVK[hArg]NFVPTDVG[Oic]FAF-*amide*

359 Ac-WVEHKLKGLLS[Cit]SGGVVK[hArg]NFVPTDVG[Oic]FAF-*amide*

360 Ac-WVEH[hCit]LKGLLS[Cit]SGGVVK[hArg]NFVP[NmeThr]DVG[Oic]FAF-*amide*

361 Ac-WVEH[Orn]LKGLLS[Cit]SGGVVK[hArg]NFVP[NmeThr]DVG[Oic]FAF-*amide*

362 Ac-WVEHHLKGLLS[Cit]SGGVVK[hArg]NFVP[NmeThr]DVG[Oic]FA[2-Nal]-*amide*

363 Ac-WVCHRLCGLLS[Cit]SGGVV[hArg]KNFVP[NmeThr]DVG[Oic]FA[1-Nal]-*amide*

364 Ac-WVCHRLCGLLS[Cit]SGGVV[hArg]KNFVP[NmeThr]DVG[Pip]FAY-*amide*

365 Ac-WVCHRLCGLLS[Cit]SGGVV[hArg]KNFVP[NmeThr]DVG[Hyp]FAH-*amide*

366 Ac-WVCHRLCGLLS[Cit]SGGVV[hArg]KNFVP[NmeThr]DVG[Hyp]FA[Bip]-*amide*

367 Ac-WVCHRLCGLLS[Cit]SGGVV[hArg]KNFVP[NmeThr]DVG[Aic]FA[2-Nal]-*amide*

368 Ac-WVCHRLCGLLS[Cit]SGGVV[hArg]KNFVP[NmeThr]DVG[Aic]FAW-*amide*

369 Ac-WVEH[Cit]LKGLLS[Cit]SGGVV[NMeArg]KNFVPTDVG[Oic]FAF-*amide*

370 Ac-WVEHRLKGLLS[Cit]SGGVV[NMeArg]KNFVPTDVG[Oic]FAF-*amide*

371 Ac-WVEH[Cit]LKGLLS[Cit]SGGVV[NMeArg]KNFVP[NmeThr]DVG[Oic]FAF-*amide*

372 Ac-WVEHRLKGLLS[Cit]SGGVV[NMeArg]KNFVP[NmeThr]DVG[Oic]FAF-*amide*

373 Ac-WVEH[Cit]LKGLLS[Cit]SGGVV[NMeArg]KNFVPTDVG[Oic]FAF-*amide*

374 Ac-WVEHRLKGLLS[Cit]SGGVV[NMeArg]KNFVPTDVG[Oic]FAF-*amide*

375 Ac-WVEH[Cit]LKGLLS[Cit]SGGVV[NMeArg]KNFVP[NmeThr]DVG[Oic]FAF-*amide*

376 Ac-WVEHRLKGLLS[Cit]SGGVV[NMeArg]KNFVP[NmeThr]DVG[Oic]FAF-*amide*

377 Ac-WVEH[Cit]LKGLLS[Cit]SGGVV[NMeArg]KNFVP[NmeThr]DVG[Oic]FA[2-Nal]-*amide*

378 Ac-WVEH[NMeArg]LKGLLS[Cit]SGGVV[NMeArg]KNFVPTDVG[Oic]FAF-*amide*

379 Ac-WVEHKLKGLLS[Cit]SGGVV[NMeArg]KNFVPTDVG[Oic]FAF-*amide*

380 Ac-WVEH[hCit]LKGLLS[Cit]SGGVV[NMeArg]KNFVP[NmeThr]DVG[Oic]FAF-*amide*

381 Ac-WVEH[Orn]LKGLLS[Cit]SGGVV[NMeArg]KNFVP[NmeThr]DVG[Oic]FAF-*amide*

382 Ac-WVEHHLKGLLS[Cit]SGGVV[NMeArg]KNFVP[NmeThr]DVG[Oic]FA[2-Nal]-*amide*

383 Ac-WVDH[Cit]LKGLLS[Cit]SGGVV[NMeArg]KNFVPTDVG[Oic]FAF-*amide*

384 Ac-WVDHRLKGLLS[Cit]SGGVV[NMeArg]KNFVPTDVG[Oic]FAF-*amide*

385 Ac-WVDH[Cit]LKGLLS[Cit]SGGVV[NMeArg]KNFVP[NmeThr]DVG[Oic]FAF-*amide*

386 Ac-WVDHRLKGLLS[Cit]SGGVV[NMeArg]KNFVP[NmeThr]DVG[Oic]FAF-*amide*

387 Ac-WVDH[Cit]LKGLLS[Cit]SGGVV[NMeArg]KNFVP[NmeThr]DVG[Oic]FA[2-Nal]-*amide*

388 Ac-WVEH[Cit]LKGLLS[Cit]SGGVVRKNFVPTDVG[Oic]FAF-*amide*

389 Ac-WVEHRLKGLLS[Cit]SGGVVRKNFVPTDVG[Oic]FAF-*amide*

390 Ac-WVEH[Cit]LKGLLS[Cit]SGGVVRKNFVP[NmeThr]DVG[Oic]FAF-*amide*

391 Ac-WVEHRLKGLLS[Cit]SGGVVRKNFVP[NmeThr]DVG[Oic]FAF-*amide*

392 Ac-WVEH[Cit]LKGLLS[Cit]SGGVVRKNFVPTDVG[Oic]FAF-*amide*

393 Ac-WVEHRLKGLLS[Cit]SGGVVRKNFVPTDVG[Oic]FAF-*amide*

TABLE 2B-continued

Additional exemplary CGRP peptide sequences. Underlined boldface amino acid residues, if any, indicate covalent cyclization between the first underlined boldface residue and the second underlined boldface residue in a sequence.

| SEQ ID NO | CGRP Peptide Sequence |
|---|---|
| 394 | Ac-WVEH[Cit]LKGLLS[Cit]SGGVVRKNFVP[NmeThr]DVG[Oic]FAF-amide |
| 395 | Ac-WVEHRLKGLLS[Cit]SGGVVRKNFVP[NMeThr]DVG[Oic]FAF-amide |
| 396 | Ac-WVEH[Cit]LKGLLS[Cit]SGGVVRKNFVP[NMeThr]DVG[Oic]FA[2-Nal]-amide |
| 397 | Ac-WVEHRLKGLLS[Cit]SGGVVRKNFVPTDVG[Oic]FAF-amide |
| 398 | Ac-WVEHKLKGLLS[Cit]SGGVVRKNFVPTDVG[Oic]FAF-amide |
| 399 | Ac-WVEH[hCit]LKGLLS[Cit]SGGVVRKNFVP[NmeThr]DVG[Oic]FAF-amide |
| 400 | Ac-WVEH[Orn]LKGLLS[Cit]SGGVVRKNFVP[NmeThr]DVG[Oic]FAF-amide |
| 401 | Ac-WVEHHLKGLLS[Cit]SGGVVRKNFVP[NmeThr]DVG[Oic]FA[2-Nal]-amide |
| 402 | Ac-WVDH[Cit]LKGLLS[Cit]SGGVVRKNFVPTDVG[Oic]FAF-amide |
| 403 | Ac-WVDHRLKGLLS[Cit]SGGVVRKNFVPTDVG[Oic]FAF-amide |
| 404 | Ac-WVDH[Cit]LKGLLS[Cit]SGGVVRKNFVP[NmeThr]DVG[Oic]FAF-amide |
| 405 | Ac-WVDHRLKGLLS[Cit]SGGVVRKNFVP[NmeThr]DVG[Oic]FAF-amide |
| 406 | Ac-WVDH[Cit]LKGLLS[Cit]SGGVVRKNFVP[NmeThr]DVG[Oic]FA[2-Nal]-amide |
| 407 | Ac-WVT[NMeHis][Cit]LAGLLS[Cit]SGGVV[hArg]KNFVPTDVG[Oic]FAF-amide |
| 408 | Ac-WVT[NMeHis][Cit]LAGLLS[Cit]SGGVV[hArg]KNFVPTDVG[Oic]FAF-amide |
| 409 | Ac-WVT[NMeHis][Cit]LAGLLS[Cit]SGGVV[hArg]KNFVP[NmeThr]DVG[Oic]FAF-amide |
| 410 | Ac-WVT[NMeHis][Cit]LAGLLS[Cit]SGGVV[hArg]KNFVP[NmeThr]DVG[Oic]FAF-amide |
| 411 | Ac-VVVT[NMeHis][Cit]LAGLLS[Cit]SGGVV[hArg]KNFVP[NmeThr]DVG[Oic]FA[2-Nal]-amide |
| 412 | Ac-WVT[NMeHis][Cit]LAGLLS[Cit]SGGVV[hArg]KNFVP[NmeThr]DVG[Oic]FA[1-Nal]-amide |
| 413 | Ac-WVT[NMeHis][Cit]LAGLLS[Cit]SGGVV[hArg]KNFVP[NmeThr]DVG[Oic]FAW-amide |
| 414 | Ac-WVT[NMeHis][Cit]LAGLLS[Cit]SGGVV[hArg]KNFVP[NmeThr]DVG[Oic]FAY-amide |
| 415 | Ac-WVT[NMeHis][Cit]LAGLLS[Cit]SGGVV[hArg]KNFVP[NmeThr]DVG[Oic]FAH-amide |
| 416 | Ac-[1-Nal]VEH[Cit]LKGLLS[Cit]SGGVV[hArg]KNFVPTDVG[Oic]FAF-amide |
| 417 | Ac-[1-Nal]VEHRLKGLLS[Cit]SGGVV[hArg]KNFVPTDVG[Oic]FAF-amide |
| 418 | Ac-[1-Nal]VEH[Cit]LKGLLS[Cit]SGGVV[hArg]KNFVP[NmeThr]DVG[Oic]FAF-amide |
| 419 | Ac-[1-Nal]VEHRLKGLLS[Cit]SGGVV[hArg]KNFVP[NmeThr]DVG[Oic]FAF-amide |
| 420 | Ac-[1-Nal]VEH[Cit]LKGLLS[Cit]SGGVV[hArg]KNFVP[NmeThr]DVG[Oic]FA[2-Nal]-amide |
| 421 | Z-WVEH[Cit]LKGLLS[Cit]SGGVV[hArg]KNFVPTDVG[Oic]FAF-amide |
| 422 | Z-WVEHRLKGLLS[Cit]SGGVV[hArg]KNFVPTDVG[Oic]FAF-amide |
| 423 | Z-WVEH[Cit]LKGLLS[Cit]SGGVV[hArg]KNFVP[NmeThr]DVG[Oic]FAF-amide |
| 424 | Z-WVEHRLKGLLS[Cit]SGGVV[hArg]KNFVP[NmeThr]DVG[Oic]FAF-amide |
| 425 | Z-WVEH[Cit]LKGLLS[Cit]SGGVV[hArg]KNFVP[NmeThr]DVG[Oic]FA[2-Nal]-amide |
| 426 | Bzl-WVEH[Cit]LKGLLS[Cit]SGGVV[hArg]KNFVPTDVG[Oic]FAF-amide |
| 427 | Bzl-WVEHRLKGLLS[Cit]SGGVV[hArg]KNFVPTDVG[Oic]FAF-amide |
| 428 | Bzl-WVEH[Cit]LKGLLS[Cit]SGGVV[hArg]KNFVP[NmeThr]DVG[Oic]FAF-amide |

TABLE 2B-continued

Additional exemplary CGRP peptide sequences. Underlined boldface amino acid residues, if any, indicate covalent cyclization between the first underlined boldface residue and the second underlined boldface residue in a sequence.

SEQ ID NO CGRP Peptide Sequence

429 *Bzl*-WVEHRLKGLLS[Cit]SGGVV[hArg]KNFVP[NmeThr]DVG[Oic]FAF-*amide*

430 *Bzl*-WVEH[Cit]LKGLLS[Cit]SGGVV[hArg]KNFVP[NmeThr]DVG[Oic]FA[2-Nal]-*amide*

431 *Z*-WVT[NMeHis][Cit]LAGLLS[Cit]SGGVV[hArg]KNFVP[NmeThr]DVG[Oic]FA[1-Nal]-*amide*

432 *Z*-WVT[NMeHis][Cit]LAGLLS[Cit]SGGVV[hArg]KNFVP[NmeThr]DVG[Oic]FAW-*amide*

433 *Z*-WVT[NMeHis][Cit]LAGLLS[Cit]SGGVV[hArg]KNFVP[NmeThr]DVG[Oic]FAY-*amide*

434 *Z*-WVT[NMeHis][Cit]LAGLLS[Cit]SGGVV[hArg]KNFVP[NmeThr]DVG[Oic]FAH-*amide*

435 *Bzl*-WVT[NMeHis][Cit]LAGLLS[Cit]SGGVV[hArg]KNFVP[NmeThr]DVG[Oic]FA[1-Nal]-*amide*

436 *Bzl*-WVT[NMeHis][Cit]LAGLLS[Cit]SGGVV[hArg]KNFVP[NmeThr]DVG[Oic]FAW-*amide*

437 *Bzl*-WVT[NMeHis][Cit]LAGLLS[Cit]SGGVV[hArg]KNFVP[NmeThr]DVG[Oic]FAY-*amide*

438 *Bzl*-WVT[NMeHis][Cit]LAGLLS[Cit]SGGVV[hArg]KNFVP[NmeThr]DVG[Oic]FAH-*amide*

439 *Bzl*-WVCHRLCGLLS[Cit]SGGVV[hArg]KNFVP[NmeThr]DVG[Oic]FA[1-Nal]-*amide*

440 *Bzl*-WVCHRLCGLLS[Cit]SGGVV[hArg]KNFVP[NmeThr]DVG[Pip]FAY-*amide*

441 *Bzl*-WVCHRLCGLLS[Cit]SGGVV[hArg]KNFVP[NmeThr]DVG[Hyp]FAH-*amide*

442 *Bzl*-WVCHRLCGLLS[Cit]SGGVV[hArg]KNFVP[NMeThr]DVG[Hyp]FA[Bip]-*amide*

443 *Bzl*-WVCHRLCGLLS[Cit]SGGVV[hArg]KNFVP[NmeThr]DVG[Aic]FA[2-Nal]-*amide*

444 *Bzl*-WVCHRLCGLLS[Cit]SGGVV[hArg]KNFVP[NmeThr]DVG[Aic]FAW-*amide*

445 *Ac*-EVTHKLAGLLS[Cit]SGGVV[hArg]KNFVP[NmeThr]DVG[Oic]FAF-*amide*

446 *Ac*-WETH[Cit]KAGLLS[Cit]SGGVV[hArg]KNFVP[NmeThr]DVG[Oic]FAF-*amide*

447 *Ac*-WVEH[Cit]LKGLLS[Cit]SGGVV[hArg]KNFVP[NmeThr]DVG[Oic]FAF-*amide*

448 *Ac*-WVTE[Cit]LAKLLS[Cit]SGGVV[hArg]KNFVP[NmeThr]DVG[Oic]FAF-*amide*

449 *Ac*-WVTHELAGKLS[Cit]SGGVV[hArg]KNFVP[NmeThr]DVG[Oic]FAF-*amide*

450 *Ac*-WVTH[Cit]EAGLKS[Cit]SGGVV[hArg]KNFVP[NmeThr]DVG[Oic]FAF-*amide*

451 *Ac*-WVTH[Cit]LEGLLK[Cit]SGGVV[hArg]KNFVP[NmeThr]DVG[Oic]FAF-*amide*

452 *Ac*-WVTH[Cit]LAELLSKSGGVV[hArg]KNFVP[NmeThr]DVG[Oic]FAF-*amide*

453 *Ac*-WVTH[Cit]LAGELS[Cit]KGGVV[hArg]KNFVP[NmeThr]DVG[Oic]FAF-*amide*

454 *Ac*-WVTH[Cit]LAGLES[Cit]SKGVV[hArg]KNFVP[NmeThr]DVG[Oic]FAF-*amide*

455 *Ac*-WVTH[Cit]LAGLLE[Cit]SGKVV[hArg]KNFVP[NmeThr]DVG[Oic]FAF-*amide*

456 *Ac*-WVTH[Cit]LAGLLSESGGKV[hArg]KNFVP[NmeThr]DVG[Oic]FAF-*amide*

457 *Ac*-WVTH[Cit]LAGLLS[Cit]EGGVK[hArg]KNFVP[NmeThr]DVG[Oic]FAF-*amide*

458 *Ac*-WVTH[Cit]LAGLLS[Cit]SGGVV[hArg]KKFVP[NmeThr]DVG[Oic]FAF-*amide*

459 *Ac*-WVTH[Cit]LAGLLS[Cit]SGGVV[hArg]KNKVP[NmeThr]DDG[Oic]FAF-*amide*

460 *Ac*-WVTH[Cit]LAGLLS[Cit]SGGVV[hArg]KNFKP[NmeThr]DVD[Oic]FAF-*amide*

461 *Ac*-WVTH[Cit]LAGLLS[Cit]SGGVV[hArg]KNFVPKDVG[Oic]DAF-*amide*

462 *Ac*-WVTH[Cit]LAGLLS[Cit]SGGVV[hArg]KNFVP[NmeThr]KVG[Oic]FDF-*amide*

463 *Ac*-WVTH[Cit]LAGLLS[Cit]SGGVV[hArg]KNFVP[NmeThr]DKG[Oic]FAD-*amide*

464 *Ac*-WVEH[Cit]LKGLLS[Cit]SGGVVKNNFVPTDVG[Oic]FAF-*amide*

TABLE 2B-continued

Additional exemplary CGRP peptide sequences. Underlined boldface amino acid residues, if any, indicate covalent cyclization between the first underlined boldface residue and the second underlined boldface residue in a sequence.

| SEQ ID NO | CGRP Peptide Sequence |
|---|---|
| 465 | Ac-WVEHRLKGLLS[Cit]SGGVVKNNFVPTDVG[Oic]FAF-amide |
| 466 | Ac-WVEH[Cit]LKGLLS[Cit]SGGVVKNNFVP[NmeThr]DVG[Oic]FAF-amide |
| 467 | Ac-WVEHRLKGLLS[Cit]SGGVVKNNFVP[NmeThr]DVG[Oic]FAF-amide |
| 468 | Ac-WVEH[Cit]LKGLLS[Cit]SGGVVKNNFVP[NmeThr]DVG[Oic]FA[2-Nal]-amide |
| 469 | Ac-WVEH[hArg]LKGLLS[Cit]SGGVVKNNFVPTDVG[Oic]FAF-amide |
| 470 | Ac-WVEHKLKGLLS[Cit]SGGVVKNNFVPTDVG[Oic]FAF-amide |
| 471 | Ac-WVEH[hCit]LKGLLS[Cit]SGGVVKNNFVP[NmeThr]DVG[Oic]FAF-amide |
| 472 | Ac-WVEH[Orn]LKGLLS[Cit]SGGVVKNNFVP[NmeThr]DVG[Oic]FAF-amide |
| 473 | Ac-WVEHHLKGLLS[Cit]SGGVVKNNFVP[NmeThr]DVG[Oic]FA[2-Nal]-amide |
| 474 | Ac-WVDH[Cit]LKGLLS[Cit]SGGVVKNNFVPTDVG[Oic]FAF-amide |
| 475 | Ac-WVDHRLKGLLS[Cit]SGGVVKNNFVPTDVG[Oic]FAF-amide |
| 476 | Ac-WVDH[Cit]LKGLLS[Cit]SGGVVKNNFVP[NmeThr]DVG[Oic]FAF-amide |
| 477 | Ac-WVDHRLKGLLS[Cit]SGGVVKNNFVP[NmeThr]DVG[Oic]FAF-amide |
| 478 | Ac-WVDH[Cit]LKGLLS[Cit]SGGVVKNNFVP[NmeThr]DVG[Oic]FA[2-Nal]-amide |
| 479 | Ac-WVEH[Cit]LKGLLS[Cit]SGGVVKNNFVP[NmeThr]DVG[Oic]FAW-amide |
| 480 | Ac-WVEH[Cit]LKGLLS[Cit]SGGVVKNNFVP[NmeThr]DVG[Oic]FAH-amide |
| 481 | Ac-WVEH[Cit]LKGLLS[Cit]SGGVVKNNFVP[NmeThr]DVG[Oic]FA[1-Nal]-amide |
| 482 | Ac-WVEH[Cit]LKGLLS[Cit]SGGVVKNNFVP[NmeThr]DVG[Oic]FA[Bip]-amide |
| 483 | Ac-WVEH[Cit]LKGLLS[Cit]SGGVVKNNFVP[NmeThr]DVG[Oic]FA[Tic]-amide |
| 484 | Ac-WVEH[Cit]LKG LLS[Cit]SGGVVKNNFVP[NmeThr]DVG[Oic]FAY-amide |
| 485 | Ac-WVEHRLKGLLS[Cit]SGGVVKNNFVPTDVG[Oic]FAF-amide |
| 486 | Ac-WVEHRLKGLLS[Cit]SGGVVKNNFVPTDVG[Pip]FAF-amide |
| 487 | Ac-WVEHRLKGLLS[Cit]SGGVVKNNFVPTDVG[Hyp]FAF-amide |
| 488 | Ac-WVEHRLKGLLS[Cit]SGGVVKNNFVPTDVG[Hyp]FAF-amide |
| 489 | Ac-WVEHRLKGLLS[Cit]SGGVVKNNFVPTDVG[Aic]FAF-amide |
| 490 | Ac-WVEHRLKGLLS[Cit]SGGVVKNNFVPTDVG[Aic]FAF-amide |
| 491 | Ac-WVEHRLKGLLS[Cit]SGGVVKNNFVPTDVG[Aib]FAF-amide |
| 492 | Ac-WVEHRLKGLLS[Cit]SGGVVKNNFVPTDVG[Thz]FAF-amide |
| 493 | Ac-WVEHRLKGLLS[Cit]SGGVVKNNFVPTDVG[Sar]FAF-amide |
| 494 | Ac-WVEHRLKGLLS[Cit]SGGVVKNNFVPTDVG[Sar]FAF-amide |
| 495 | Ac-WVEHRLKGLLS[Cit]SGGVVKNNFVPTDVG[Tpi]FAF-amide |
| 496 | Ac-WVEHRLKGLLS[Cit]SGGVVKNNFVPTDVG[Oic]FAF-amide |
| 497 | Ac-WVEHRLKGLLS[Cit]SGGVVKNNFVPTDVG[Pip]FAF-amide |
| 498 | Ac-WVEHRLKGLLS[Cit]SGGVVKNNFVPTDVG[Hyp]FAF-amide |
| 499 | Ac-WVTH[Cit]LAGLLS[Cit]SGGVVKNNFVPTDVG[Oic]FAF-amide |

TABLE 2B-continued

Additional exemplary CGRP peptide sequences. Underlined boldface amino acid residues, if any, indicate covalent cyclization between the first underlined boldface residue and the second underlined boldface residue in a sequence.

| SEQ ID NO | CGRP Peptide Sequence |
|---|---|
| 500 | Ac-WVTH[Cit]LAGLLS[Cit]SGGVVKNNFVPTDVG[Pip]FAF-amide |
| 501 | Ac-WVTH[Cit]LAGLLS[Cit]SGGVVKNNFVPTDVG[Hyp]FAF-amide |
| 502 | Ac-WVTH[Cit]LAGLLS[Cit]SGGVVKNNFVPTDVG[Hyp]FAF-amide |
| 503 | Ac-WVTH[Cit]LAGLLS[Cit]SGGVVKNNFVPTDVG[Aic]FAF-amide |
| 504 | Ac-WVTH[Cit]LAGLLS[Cit]SGGVVKNNFVPTDVG[Aic]FAF-amide |
| 505 | Ac-WVTH[Cit]LAGLLS[Cit]SGGVVKNNFVPTDVG[Aib]FAF-amide |
| 506 | Ac-WVTH[Cit]LAGLLS[Cit]SGGVVKNNFVPTDVG[Thz]FAF-amide |
| 507 | Ac-WVTH[Cit]LAGLLS[Cit]SGGVVKNNFVPTDVG[Sar]FAF-amide |
| 508 | Ac-WVTH[Cit]LAGLLS[Cit]SGGVVKNNFVPTDVG[Sar]FAF-amide |
| 509 | Ac-WVTH[Cit]LAGLLS[Cit]SGGVVKNNFVPTDVG[Tpi]FAF-amide |
| 510 | Ac-WVTH[Cit]LAGLLS[Cit]SGGVVKNNFVPTDVG[Pip]FAF-amide |
| 511 | Ac-WVTH[Cit]LAGLLS[Cit]SGGVVKNNFVPTDVG[Hyp]FAF-amide |
| 512 | Ac-WVEHRLKGLLS[Cit]SGGVVKNNFVP[NmeThr]DVG[Oic]FAF-amide |
| 513 | Ac-WVEHRLKGLLS[Cit]SGGVVKNNFVP[NMeThr]DVG[Pip]FAF-amide |
| 514 | Ac-WVEHRLKGLLS[Cit]SGGVVKNNFVP[NmeThr]DVG[Hyp]FAF-amide |
| 515 | Ac-WVEHRLKGLLS[Cit]SGGVVKNNFVP[NmeThr]DVG[Hyp]FAF-amide |
| 516 | Ac-WVEHRLKGLLS[Cit]SGGVVKNNFVP[NmeThr]DVG[Aic]FAF-amide |
| 517 | Ac-WVEHRLKGLLS[Cit]SGGVVKNNFVP[NmeThr]DVG[Aic]FAF-amide |
| 518 | Ac-WVEHRLKGLLS[Cit]SGGVVKNNFVP[NmeThr]DVG[Aib]FAF-amide |
| 519 | Ac-WVEHRLKGLLS[Cit]SGGVVKNNFVP[NmeThr]DVG[Thz]FAF-amide |
| 520 | Ac-WVEHRLKGLLS[Cit]SGGVVKNNFVP[NmeThr]DVG[Sar]FAF-amide |
| 521 | Ac-WVEHRLKGLLS[Cit]SGGVVKNNFVP[NMeThr]DVG[Sar]FAF-amide |
| 522 | Ac-WVEHRLKGLLS[Cit]SGGVVKNNFVP[NmeThr]DVG[Tpi]FAF-amide |
| 523 | Ac-WVEHRLKGLLS[Cit]SGGVVKNNFVP[NmeThr]DVG[Oic]FAF-amide |
| 524 | Ac-WVEHRLKGLLS[Cit]SGGVVKNNFVP[NmeThr]DVG[Pip]FAF-amide |
| 525 | Ac-WVEHRLKGLLS[Cit]SGGVVKNNFVP[NmeThr]DVG[Hyp]FAF-amide |
| 526 | Ac-WVEHRLKGLLS[Cit]SGGVVKNNFVP[NmeThr]DVG[Oic]FA[1-Nal]-amide |
| 527 | Ac-WVEHRLKGLLS[Cit]SGGVVKNNFVP[NmeThr]DVG[Pip]FAY-amide |
| 528 | Ac-WVEHRLKGLLS[Cit]SGGVVKNNFVP[NmeThr]DVG[Hyp]FAH-amide |
| 529 | Ac-WVEHRLKGLLS[Cit]SGGVVKNNFVP[NmeThr]DVG[Hyp]FA[Bip]-amide |
| 530 | Ac-WVEHRLKGLLS[Cit]SGGVVKNNFVP[NmeThr]DVG[Aic]FA[2-Nal]-amide |
| 531 | Ac-WVEHRLKGLLS[Cit]SGGVVKNNFVP[NmeThr]DVG[Aic]FAW-amide |
| 532 | Ac-WVEH[Cit]LKGLLS[Cit]SGGVVK[Sar]NFVPTDVG[Oic]FAF-amide |
| 533 | Ac-WVEHRLKGLLS[Cit]SGGVVK[Sar]NFVPTDVG[Oic]FAF-amide |
| 534 | Ac-WVEH[Cit]LKGLLS[Cit]SGGVVK[Sar]NFVP[NmeThr]DVG[Oic]FAF-amide |
| 535 | Ac-WVEHRLKGLLS[Cit]SGGVVK[Sar]NFVP[NmeThr]DVG[Oic]FAF-amide |

TABLE 2B-continued

Additional exemplary CGRP peptide sequences. Underlined boldface amino acid residues, if any, indicate covalent cyclization between the first underlined boldface residue and the second underlined boldface residue in a sequence.

| SEQ ID NO | CGRP Peptide Sequence |
|---|---|
| 536 | Ac-WVEH[Cit]LKGLLS[Cit]SGGVVK[Sar]NFVP[NmeThr]DVG[Oic]FA[2-Nal]-amide |
| 537 | Ac-WVEH[hArg]LKGLLS[Cit]SGGVVK[Sar]NFVPTDVG[Oic]FAF-amide |
| 538 | Ac-WVEHKLKGLLS[Cit]SGGVVK[Sar]NFVPTDVG[Oic]FAF-amide |
| 539 | Ac-WVEH[hCit]LKGLLS[Cit]SGGVVK[Sar]NFVP[NmeThr]DVG[Oic]FAF-amide |
| 540 | Ac-WVEH[Orn]LKGLLS[Cit]SGGVVK[Sar]NFVP[NmeThr]DVG[Oic]FAF-amide |
| 541 | Ac-WVEHHLKGLLS[Cit]SGGVVK[Sar]NFVP[NmeThr]DVG[Oic]FA[2-Nal]-amide |
| 542 | Ac-WVDH[Cit]LKGLLS[Cit]SGGVVK[Sar]NFVPTDVG[Oic]FAF-amide |
| 543 | Ac-WVDHRLKGLLS[Cit]SGGVVK[Sar]NFVPTDVG[Oic]FAF-amide |
| 544 | Ac-WVDH[Cit]LKGLLS[Cit]SGGVVK[Sar]NFVP[NmeThr]DVG[Oic]FAF-amide |
| 545 | Ac-WVDHRLKGLLS[Cit]SGGVVK[Sar]NFVP[NmeThr]DVG[Oic]FAF-amide |
| 546 | Ac-WVDH[Cit]LKGLLS[Cit]SGGVVK[Sar]NFVP[NmeThr]DVG[Oic]FA[2-Nal]-amide |
| 547 | Ac-WVEH[Cit]LKGLLS[Cit]SGGVVK[Sar]NFVP[NmeThr]DVG[Oic]FAW-amide |
| 548 | Ac-WVEH[Cit]LKGLLS[Cit]SGGVVK[Sar]NFVP[NmeThr]DVG[Oic]FAH-amide |
| 549 | Ac-WVEH[Cit]LKGLLS[Cit]SGGVVK[Sar]NFVP[NmeThr]DVG[Oic]FA[1-Nal]-amide |
| 550 | Ac-WVEH[Cit]LKGLLS[Cit]SGGVVK[Sar]NFVP[NmeThr]DVG[Oic]FA[Bip]-amide |
| 551 | Ac-WVEH[Cit]LKGLLS[Cit]SGGVVK[Sar]NFVP[NmeThr]DVG[Oic]FA[Tic]-amide |
| 552 | Ac-WVEH[Cit]LKGLLS[Cit]SGGVVK[Sar]NFVP[NmeThr]DVG[Oic]FAY-amide |
| 553 | Ac-WVEHRLKGLLS[Cit]SGGVVK[Sar]NFVPTDVG[Oic]FAF-amide |
| 554 | Ac-WVEHRLKGLLS[Cit]SGGVVK[Sar]NFVPTDVG[Pip]FAF-amide |
| 555 | Ac-WVEHRLKGLLS[Cit]SGGVVK[Sar]NFVPTDVG[Hyp]FAF-amide |
| 556 | Ac-WVEHRLKGLLS[Cit]SGGVVK[Sar]NFVPTDVG[Hyp]FAF-amide |
| 557 | Ac-WVEHRLKGLLS[Cit]SGGVVK[Sar]NFVPTDVG[Aic]FAF-amide |
| 558 | Ac-WVEHRLKGLLS[Cit]SGGVVK[Sar]NFVPTDVG[Aic]FAF-amide |
| 559 | Ac-WVEHRLKGLLS[Cit]SGGVVK[Sar]NFVPTDVG[Aib]FAF-amide |
| 560 | Ac-WVEHRLKGLLS[Cit]SGGVVK[Sar]NFVPTDVG[Thz]FAF-amide |
| 561 | Ac-WVEHRLKGLLS[Cit]SGGVVK[Sar]NFVPTDVG[Sar]FAF-amide |
| 562 | Ac-WVEHRLKGLLS[Cit]SGGVVK[Sar]NFVPTDVG[Sar]FAF-amide |
| 563 | Ac-WVEHRLKGLLS[Cit]SGGVVK[Sar]NFVPTDVG[Tpi]FAF-amide |
| 564 | Ac-WVEHRLKGLLS[Cit]SGGVVK[Sar]NFVPTDVG[Oic]FAF-amide |
| 565 | Ac-WVEHRLKGLLS[Cit]SGGVVK[Sar]NFVPTDVG[Pip]FAF-amide |
| 566 | Ac-WVEHRLKGLLS[Cit]SGGVVK[Sar]NFVPTDVG[Hyp]FAF-amide |
| 567 | Ac-WVTH[Cit]LAGLLS[Cit]SGGVVK[Sar]NFVPTDVG[Oic]FAF-amide |
| 568 | Ac-WVTH[Cit]LAGLLS[Cit]SGGVVK[Sar]NFVPTDVG[Pip]FAF-amide |
| 569 | Ac-WVTH[Cit]LAGLLS[Cit]SGGVVK[Sar]NFVPTDVG[Hyp]FAF-amide |
| 570 | Ac-WVTH[Cit]LAGLLS[Cit]SGGVVK[Sar]NFVPTDVG[Hyp]FAF-amide |

TABLE 2B-continued

Additional exemplary CGRP peptide sequences. Underlined boldface amino acid residues, if any, indicate covalent cyclization between the first underlined boldface residue and the second underlined boldface residue in a sequence.

| SEQ ID NO | CGRP Peptide Sequence |
|---|---|
| 571 | Ac-WVTH[Cit]LAGLLS[Cit]SGGVVK[Sar]NFVPTDVG[Aic]FAF-amide |
| 572 | Ac-WVTH[Cit]LAGLLS[Cit]SGGVVK[Sar]NFVPTDVG[Aic]FAF-amide |
| 573 | Ac-WVTH[Cit]LAGLLS[Cit]SGGVVK[Sar]NFVPTDVG[Aib]FAF-amide |
| 574 | Ac-WVTH[Cit]LAGLLS[Cit]SGGVVK[Sar]NFVPTDVG[Thz]FAF-amide |
| 575 | Ac-WVTH[Cit]LAGLLS[Cit]SGGVVK[Sar]NFVPTDVG[Sar]FAF-amide |
| 576 | Ac-WVTH[Cit]LAGLLS[Cit]SGGVVK[Sar]NFVPTDVG[Sar]FAF-amide |
| 577 | Ac-WVTH[Cit]LAGLLS[Cit]SGGVVK[Sar]NFVPTDVG[Tpi]FAF-amide |
| 578 | Ac-WVTH[Cit]LAGLLS[Cit]SGGVVK[Sar]NFVPTDVG[Pip]FAF-amide |
| 579 | Ac-WVTH[Cit]LAGLLS[Cit]SGGVVK[Sar]NFVPTDVG[Hyp]FAF-amide |
| 580 | Ac-WVEHRLKGLLS[Cit]SGGVVK[Sar]NFVP[NmeThr]DVG[Oic]FAF-amide |
| 581 | Ac-WVEHRLKGLLS[Cit]SGGVVK[Sar]NFVP[NmeThr]DVG[Pip]FAF-amide |
| 582 | Ac-WVEHRLKGLLS[Cit]SGGVVK[Sar]NFVP[NmeThr]DVG[Hyp]FAF-amide |
| 583 | Ac-WVEHRLKGLLS[Cit]SGGVVK[Sar]NFVP[NmeThr]DVG[Hyp]FAF-amide |
| 584 | Ac-WVEHRLKGLLS[Cit]SGGVVK[Sar]NFVP[NmeThr]DVG[Aic]FAF-amide |
| 585 | Ac-WVEHRLKGLLS[Cit]SGGVVK[Sar]NFVP[NmeThr]DVG[Aic]FAF-amide |
| 586 | Ac-WVEHRLKGLLS[Cit]SGGVVK[Sar]NFVP[NmeThr]DVG[Aib]FAF-amide |
| 587 | Ac-WVEHRLKGLLS[Cit]SGGVVK[Sar]NFVP[NmeThr]DVG[Thz]FAF-amide |
| 588 | Ac-WVEHRLKGLLS[Cit]SGGVVK[Sar]NFVP[NmeThr]DVG[Sar]FAF-amide |
| 589 | Ac-WVEHRLKGLLS[Cit]SGGVVK[Sar]NFVP[NmeThr]DVG[Sar]FAF-amide |
| 590 | Ac-WVEHRLKGLLS[Cit]SGGVVK[Sar]NFVP[NmeThr]DVG[Tpi]FAF-amide |
| 591 | Ac-WVEHRLKGLLS[Cit]SGGVVK[Sar]NFVP[NmeThr]DVG[Oic]FAF-amide |
| 592 | Ac-WVEHRLKGLLS[Cit]SGGVVK[Sar]NFVP[NmeThr]DVG[Pip]FAF-amide |
| 593 | Ac-WVEHRLKGLLS[Cit]SGGVVK[Sar]NFVP[NmeThr]DVG[Hyp]FAF-amide |
| 594 | Ac-WVEHRLKGLLS[Cit]SGGVVK[Sar]NFVP[NmeThr]DVG[Oic]FA[1-Nal]-amide |
| 595 | Ac-WVEHRLKGLLS[Cit]SGGVVK[Sar]NFVP[NmeThr]DVG[Pip]FAY-amide |
| 596 | Ac-WVEHRLKGLLS[Cit]SGGVVK[Sar]NFVP[NmeThr]DVG[Hyp]FAH-amide |
| 597 | Ac-WVEHRLKGLLS[Cit]SGGVVK[Sar]NFVP[NmeThr]DVG[Hyp]FA[Bip]-amide |
| 598 | Ac-WVEHRLKGLLS[Cit]SGGVVK[Sar]NFVP[NmeThr]DVG[Aic]FA[2-Nal]-amide |
| 599 | Ac-WVEHRLKGLLS[Cit]SGGVVK[Sar]NFVP[NmeThr]DVG[Aic]FAW-amide |
| 600 | Ac-WVEH[Cit]LKGLLS[Cit]SGGVV[hArg]K$^{(20\ kDa\ MeO\text{-}PEG)}$NFVPTDVG[Oic]FAF-amide |
| 601 | Ac-WVEHRLKGLLS[Cit]SGGVV[hArg]K$^{(20\ kDa\ MeO\text{-}PEG)}$NFVPTDVG[Oic]FAF-amide |
| 602 | Ac-WVEH[Cit]LKGLLS[Cit]SGGVV[hArg]K$^{(20\ kDa\ MeO\text{-}PEG)}$NFVP[NmeThr]DVG[Oic]FAF-amide |
| 603 | Ac-WVEHRLKGLLS[Cit]SGGVV[hArg]K$^{(20\ kDa\ MeO\text{-}PEG)}$NFVP[NmeThr]DVG[Oic]FAF-amide |
| 604 | Ac-WVEH[Cit]LKGLLS[Cit]SGGVV[hArg]K$^{(20\ kDa\ MeO\text{-}PEG)}$NFVPTDVG[Oic]FAF-amide |
| 605 | Ac-WVEHRLKGLLS[Cit]SGGVV[hArg]K$^{(20\ kDa\ MeO\text{-}PEG)}$NFVPTDVG[Oic]FAFamide |
| 606 | Ac-WVEH[Cit]LKGLLS[Cit]SGGVV[hArg]K$^{(20\ kDa\ MeO\text{-}PEG)}$NFVP[NmeThr]DVG[Oic]FAF-amide |

TABLE 2B-continued

Additional exemplary CGRP peptide sequences. Underlined boldface amino acid residues, if any, indicate covalent cyclization between the first underlined boldface residue and the second underlined boldface residue in a sequence.

SEQ ID NO  CGRP Peptide Sequence

607 Ac-WVEHRLKGLLS[Cit]SGGVV[hArg]K$^{(20\ kDa\ MeO\text{-}PEG)}$NFVP[NmeThr]DVG[Oic]FAF-amide 608 Ac-WVEH[Cit]LKGLLS[Cit]SGGVV[hArg]K$^{(20\ kDa\ MeO\text{-}PEG)}$NFVP[NmeThr]DVG[Oic]FA[2-Nal]-amide 609 Ac-WVEH[hArg]LKGLLS[Cit]SGGVV[hArg]K$^{(20\ kDa\ MeO\text{-}PEG)}$NFVPTDVG[Oic]FAF-amide 610 Ac-WVEHKLKGLLS[Cit]SGGVV[hArg]K$^{(20\ kDa\ MeO\text{-}PEG)}$NFVPTDVG[Oic]FAF-amide 611 Ac-WVEH[hCit]LKGLLS[Cit]SGGVV[hArg]K$^{(20\ kDa\ MeO\text{-}PEG)}$NFVP[NmeThr]DVG[Oic]FAF-amide 612 Ac-WVEH[Orn]LKGLLS[Cit]SGGVV[hArg]K$^{(20\ kDa\ MeO\text{-}PEG)}$NFVP[NmeThr]DVG[Oic]FAF-amide 613 Ac-WVEHHLKGLLS[Cit]SGGVV[hArg]K$^{(20\ kDa\ MeO\text{-}PEG)}$NFVP[NmeThr]DVG[Oic]FA[2-Nal]-amide 614 Ac-WVDH[Cit]LKGLLS[Cit]SGGVV[hArg]K$^{(20\ kDa\ MeO\text{-}PEG)}$NFVPTDVG[Oic]FAF-amide 615 Ac-WVDHRLKGLLS[Cit]SGGVV[hArg]K$^{(20\ kDa\ MeO\text{-}PEG)}$NFVPTDVG[Oic]FAF-amide 616 Ac-WVDH[Cit]LKGLLS[Cit]SGGVV[hArg]K$^{(20\ kDa\ MeO\text{-}PEG)}$NFVP[NmeThr]DVG[Oic]FAF-amide 617 Ac-WVDHRLKGLLS[Cit]SGGVV[hArg]K$^{(20\ kDa\ MeO\text{-}PEG)}$NFVP[NmeThr]DVG[Oic]FAF-amide 618 Ac-WVDH[Cit]LKGLLS[Cit]SGGVV[hArg]K$^{(20\ kDa\ MeO\text{-}PEG)}$NFVP[NmeThr]DVG[Oic]FA[2-Nal]-amide 619 Ac-WVEH[Cit]LKGLLS[Cit]SGGVV[Cit]K$^{(20\ kDa\ MeO\text{-}PEG)}$NFVPTDVG[Oic]FAF-amide 620 Ac-WVEHRLKGLLs[Cit]SGGVV[Cit]K$^{(20\ kDa\ MeO\text{-}PEG)}$NFVPTDVG[Oic]FAF-amide 621 Ac-WVEH[Cit]LKGLLS[Cit]SGGVV[Cit]K$^{(20\ kDa\ MeO\text{-}PEG)}$NFVP[NmeThr]DVG[Oic]FAF-amide 622 Ac-WVEHRLKGLLS[Cit]SGGVV[Cit]K$^{(20\ kDa\ MeO\text{-}PEG)}$NFVP[NmeThr]DVG[Oic]FAF-amide 623 Ac-WVEH[Cit]LKGLLs[Cit]SGGVV[Cit]K$^{(20\ kDa\ MeO\text{-}PEG)}$NFVP[NmeThr]DVG[Oic]FA[2-Nal]-amide 624 Ac-WVEH[Cit]LKGLLS[Cit]SGGVV$^{(20\ kDa\ MeO\text{-}PEG)}$NFVPTDVG[Oic]FAFamide 625 Ac-WVEHRLKGLLS[Cit]SGGVV[Guf]K$^{(20\ kDa\ MeO\text{-}PEG)}$NFVPTDVG[Oic]FAFamide 626 Ac-WVEH[Cit]LKGLLS[Cit]SGGVV[Guf]K$^{(20\ kDa\ MeO\text{-}PEG)}$NFVP[NmeThr]DVG[Oic]FAF-amide 627 Ac-WVEHRLKGLLS[Cit]SGGVV[Guf]K$^{(20\ kDa\ MeO\text{-}PEG)}$NFVP[NmeThr]DVG[Oic]FAF-amide 628 Ac-WVEH[Cit]LKGLLS[Cit]SGGVV[Guf]K$^{(20\ kDa\ MeO\text{-}PEG)}$NFVP[NmeThr]DVG[Oic]FA[2-Nal]-amide 629 Ac-WVEH[Cit]LKGLLS[Cit]SGGVV[hArg]K$^{(20\ kDa\ MeO\text{-}PEG)}$NFVP[NmeThr]DVG[Oic]FAW-amide 630 Ac-WVEH[Cit]LKGLLS[Cit]SGGVV[hArg]K$^{(20\ kDa\ MeO\text{-}PEG)}$NFVP[NmeThr]DVG[Oic]FAH-amide 631 Ac-WVEH[Cit]LKGLLS[Cit]SGGVV[hArg]K$^{(20\ kDa\ MeO\text{-}PEG)}$NFVP[NmeThr]DVG[Oic]FA[1-Nal]-amide 632 Ac-WVEH[Cit]LKGLLS[Cit]SGGVV[hArg]k$^{(20\ kDa\ MeO\text{-}PEG)}$NFVP[NmeThr]DVG[Oic]FA[Bip]-amide 633 Ac-WVEH[Cit]LKGLLS[Cit]SGGVV[hArg]K$^{(20\ kDa\ MeO\text{-}PEG)}$NFVP[NmeThr]DVG[Oic]FA[Tic]-amide 634 Ac-WVEH[Cit]LKGLLS[Cit]SGGVV[hArg]K$^{(20\ kDa\ MeO\text{-}PEG)}$NFVP[NmeThr]DVG[Oic]FAY-amide 635 Ac-WVTW[Cit]LAGLLS[Cit]SGGVV[hArg]K$^{(20\ kDa\ MeO\text{-}PEG)}$NFVPTDVG[Oic]FAF-amide 636 Ac-WVT[NMePhe][Cit]LAGLLS[Cit]SGGVV[hArg]K$^{(20\ kDa\ MeO\text{-}PEG)}$NFVPTDVG[Oic]FAF-amide 637 Ac-WVT[NMeTyr][Cit]LAGLLS[Cit]SGGVV[hArg]K$^{(20\ kDa\ MeO\text{-}PEG)}$NFVPTDVG[Oic]FAF-amide 638 Ac-WVT[Sar][Cit]LAGLLS[Cit]SGGVV[hArg]K$^{(20\ kDa\ MeO\text{-}PEG)}$NFVPTDVG[Oic]FAF-amide 639 Ac-WVTA[Cit]LAGLLS[Cit]SGGVV[hArg]K$^{(20\ kDa\ MeO\text{-}PEG)}$NFVPTDVG[Oic]FAF-amide 640 Ac-WVTG[Cit]LAGLLS[Cit]SGGVV[hArg]K$^{(20\ kDa\ MeO\text{-}PEG)}$NFVPTDVG[Oic]FAF-amide 641 Ac-WVT[NMeLys][Cit]LAGLLS[Cit]SGGVV[hArg]K$^{(20\ kDa\ MeO\text{-}PEG)}$NFVPTDVG[Oic]FAF-amide TABLE 2B-continued Additional exemplary CGRP peptide sequences. Underlined boldface amino acid residues, if any, indicate covalent cyclization between the first underlined boldface residue and the second underlined boldface residue in a sequence.

| SEQ ID NO | CGRP Peptide Sequence |
|---|---|
| 642 | Ac-WVTW[Cit]LAGLLS[Cit]SGGVV[hArg]K[20 kDa MeO-PEG]NFVP[NmeThr]DVG[Oic]FAF-amide |
| 643 | Ac-WVT[NMePhe][Cit]LAGLLS[Cit]SGGVV[hArg]K[20 kDa MeO-PEG]NFVP[NmeThr]DVG[Oic]-FAF-amide |
| 644 | Ac-WVT[NMeTyr][Cit]LAGLLS[Cit]SGGVV[hArg]K[20 kDa MeO-PEG]NFVP[NmeThr]DVG[Oic]-FAF-amide |
| 645 | Ac-WVT[Sar][Cit]LAGLLS[Cit]SGGVV[hArg]K[20 kDa MeO-PEG]NFVP[NmeThr]DVG[Oic]FAF-amide |
| 646 | Ac-WVTA[Cit]LAGLLS[Cit]SGGVV[hArg]K[20 kDa MeO-PEG]NFVP[NmeThr]DVG[Oic]FAF-amide |
| 647 | Ac-WVTG[Cit]LAGLLS[Cit]SGGVV[hArg]K[20 kDa MeO-PEG]NFVP[NmeThr]DVG[Oic]FAF-amide |
| 648 | Ac-WVT[NMeLys][Cit]LAGLLS[Cit]SGGVV[hArg]K[20 kDa MeO-PEG]NFVP[NmeThr]DVG[Oic]FAF-amide |
| 649 | Ac-WVTW[Cit]LAGLLS[Cit]SGGVVK[Sar]NFVPTDVG[Oic]FAF-amide |
| 650 | Ac-WVTW[Cit]LAGLLS[Cit]SGGVVK[Sar]NFVP[NmeThr]DVG[Oic]FAF-amide |
| 651 | Ac-WVTW[Cit]LAGLLS[Cit]SGGVVKNNFVPTDVG[Oic]FAF-amide |
| 652 | Ac-WVTW[Cit]LAGLLS[Cit]SGGVVKNNFVP[NmeThr]DVG[Oic]FAF-amide |

TABLE 2C

Additional exemplary CGRP peptide sequences, including N-terminally PEGylated. Underlined boldface amino acid residues, if any, indicate covalent cyclization between the first underlined boldface residue and the second underlined boldface residue in a sequence. If present, third and fourth underlined boldface amino acid residues in a sequence (in the N- to C-terminal direction) indicate cyclization between the third underlined boldface residue and the fourth underlined boldface residue. IC 50 values, if present, were determined as describe in Example 1 herein. In most cases in Table 2C the PEG conjugation site is at the Lys[25] residue relative to reference SEQ ID NO:43.

| SEQ ID NO | CGRP Peptide Sequence | Peptide IC50 (nM) | PEG-peptide IC50 (nM) |
|---|---|---|---|
| 856 | Ac-WVTHRLAGLLSQSGGVVRKNFVPTDVGPFAF-NH2 | 0.47 | 0.46 |
| 857 | Ac-WVTHQLAGLLSQSGGVVRKNFVPTDVGPFAF-NH2 | 0.53 | 6.21 |
| 858 | Ac-WVTHRLAGLLPRSGGVVRKNFVPTDVGPFAF-NH2 | 1.3 | 5 |
| 859 | Ac-WVTHRLAGLASRPGGVVRKNFVPTDVGPFAF-NH2 | 1.41 | 60.5 |
| 860 | Ac-WVTHRLAGLLSRPGGVVRKNFVPTDVGPFAF-NH2 | 1.42 | 16.7 |
| 861 | Ac-WVTH[Cit]LAGLLSRSGGVVRKNFVPTDVGPFAF-NH2 | 0.57 | 2.08 |
| 862 | Ac-WVTHRLAGLLS[Cit]SGGVVRKNFVPTDVGPFAF-NH2 | 0.58 | 0.96 |
| 863 | Ac-WVTH[Cit]LAGLLS[Cit]SGGVVRKNFVPTDVGPFAF-NH2 | 1.8 | 3.74 |
| 864 | Ac-WVTHRLAGLLS[hArg]SGGVVRKNFVPTDVGPFAF-NH2 | 0.57 | 0.33 |
| 865 | Ac-WVTH[hArg]LAGLLSRSGGVVRKNFVPTDVGPFAF-NH2 | 0.44 | 0.36 |
| 866 | Ac-WVTH[hArg]LAGLLS[hArg]SGGVVRKNFVPTDVGPFAF-NH2 | 2.1 | 0.37 |
| 867 | Ac-WVTH[Cit]ILAGLLPRSGGVVRKNFVPTDVGPFAF-NH2 | 2.31 | 146 |
| 868 | Ac-WVTH[Cit]LAGLLSRPGGVVRKNFVPTDVGPFAF-NH2 | 3 | 108 |
| 869 | Ac-WVTH[Cit]LAGLASRPGGVVRKNFVPTDVGPFAF-NH2 | 6.19 | 565 |
| 870 | Ac-WVTH[Cit]LAGLAS[Cit]SGGVVRKNFVPTDVGPFAF-NH2 | 16.1 | >1000 |
| 871 | Ac-WVTH[Cit]LAGLLS[Cit]SGGVV[hArg]KNFVPTDVGPFAF-NH2 | 0.41 | 3.22 |
| 872 | Ac-[1-Nal]VTH[Cit]LAGLLS[Cit]SGGVVRKNFVPTDVGPFAF-NH2 | 1.6 | 11.04 |
| 873 | Ac-WVTH[Cit][Nva]AG[Nva][Nva]T[Cit]SGGVVRKNFVPTDVGPFAF-NH2 | 63 | |
| 874 | Ac-WVTHR[NMeLeu]AGLLSR[NMeSer]GGVVRKNFVPTDVGPFAF-NH2 | 2.92 | 208.2 |
| 875 | Ac-WVTH[NMeArg]LAGLLS[NMeArg]SGGVVRKNFVPTDVGPFAF-NH2 | 1.63 | |
| 876 | Ac-WVTHRLAGLLSRSGGVVRKNFV[Tic]TDVGPFAF-NH2 | 2.33 | |
| 877 | Ac-WVTH[Cit]LAGLLS[Cit]SGGVVRKNFV[Hyp]TDVGPFAF-NH2 | 1.81 | |
| 878 | Ac-WVTHR[hCit]LAGLLS[hCit]SGGVVRKNFVPTDVGPFAF-NH2 | 1.99 | |
| 879 | Ac-WVTHRLAGLLSRSGGVVRKNFV[Aib]TDVGPFAF-NH2 | 4.2 | |
| 880 | Ac-WVTH[Cit]LAGLLS[hArg]SGGVV[hArg]KNFVPTDVGPFAF-NH2 | | 2.06 |
| 881 | Ac-WVTH[hArg]LAGLLS[Cit]SGGVV[hArg]KNFVPTDVGPFAF-NH2 | | 2.58 |

TABLE 2C-continued

Additional exemplary CGRP peptide sequences, including N-terminally PEGylated. Underlined boldface amino acid residues, if any, indicate covalent cyclization between the first underlined boldface residue and the second underlined boldface residue in a sequence. If present, third and fourth underlined boldface amino acid residues in a sequence (in the N-to C-terminal direction) indicate cyclization between the third underlined boldface residue and the fourth underlined boldface residue. IC 50 values, if present, were determined as describe in Example 1 herein. In most cases in Table 2C the PEG conjugation site is at the Lys$^{25}$ residue relative to reference SEQ ID NO:43.

| SEQ ID NO | CGRP Peptide Sequence | Peptide IC50 (nM) | PEG-peptide IC50 (nM) |
|---|---|---|---|
| 882 | Ac-WVTH[hArg]LAGLLS[hArg]SCGVV[hArg]KNFVPTDVGPFAF-NH2 | | 1.46 |
| 883 | Ac-WVTH[Cit]LAGLLSQSGGVV[hArg]KNFVPTDVGPFAF-NH2 | | 7.42 |
| 884 | Ac-WVTHQLAGLLS[Cit]SGGVV[hArg]KNFVPTDVGPFAF-NH2 | | 8.87 |
| 885 | Ac-WVTH[Q]LAGLLS[Q]SGGVV[hArg]KNFVPTDVGPFAFNH2 | 1.42 | 12.4 |
| 886 | Ac-WVTH[hCit]LAGLLS[Cit]SGGVV[hArg]KNFVPTDVGPFAF-NH2 | 4.96 | 22.7 |
| 887 | Ac-WVTH[hArg]LAGLLS[hCit]SGGVV[hArg]KNFVPTDVGPFAF-NH2 | 3.14 | 6.3 |
| 888 | Ac-WVTH[hCit]LAGLLS[hArg]SGGVV[hArg]KNFVPTDVGPFAF-NH2 | | 2.11 |
| 889 | Ac-WVTHRLRGELSRKGGVVRKNFVPTDVGPFAF-NH2 | 0.94 | |
| 890 | Ac-WVEHRLEGLLKRSGG VVRKN FVPTD VGPFAF-NH2 | 1.7 | 2.86 |
| 891 | Ac-WVEHRLKGLL SRSGG VVRKN FVPTD VGPFA F-NH2 | 1.47 | 3.71 |
| 892 | Ac-WVEHRLKGELSRKGGVVRKNFVPTDVGPFAF-NH2 | 1.11 | |
| 893 | Ac-WVEHR LKGLL S[Cit]SGGVVRKNFVPTDVGPFA F-NH2 | 1.64 | |
| 894 | Ac-WVEH[hArg]LKGLL S[Cit]SGG VVRKN FVPTD VGPFAF-NH2 | 1.26 | 3.54 |
| 895 | Ac-WVEHRLKGLLS[Cit]SGGVVRKNFVPTDVGPFAF-NH2 | 2.8 | |
| 896 | Ac-WVEHRLKGLLS[Cit]SGGVVRKNFVPTDVGPFAF-NH2 | 1.61 | |
| 897 | Ac-[1-Nal]VEH[hArg]LKGLLS[Cit]SGGVVRKNFVPTDVGPFAF-NH2 | 2.25 | 4.1 |
| 898 | Ac-[Aib]WVEH[hArg]LKGLLS[Cit]SGGVVRKNFVPTDVGPFAF-NH2 | 3.18 | 40.7 |
| 899 | Ac-WVEH[hArg]LKGLL S[Cit]SG[Aze]VVRKNFVPTDVGPFA F-NH2 | 1.62 | |
| 900 | Ac-[1-Nal]VEH[hArg]LKGLLS[Cit]SGGVVRKNFVPTDVGPFAF-NH2 | 2.43 | |
| 901 | Ac-WVEHRLKGELSRKGGVV[hArg]KNFVPTDVGPFAF-NH2 | 1.02 | |
| 902 | Ac-WVEHRLKGELS[Cit]KGGVV[hArg]KNFVPTDVGPFAF-NH2 | 0.49 | |
| 903 | Ac-WVTHRLEGLLKQSGGVV[hArg]KNFVPTDVGPFAF-NH2 | 3.50 | |
| 904 | Ac-WVEHRLKGLLSQSGGVV[hArg]KNFVPTDVGPFAF-NH2 | 2.03 | 6.73 |
| 905 | Ac-WVEHRLKGLLS[hArg]SGGVV[hArg]KNFVPTDVGPFAF-NH2 | 1.70 | 3.70 |
| 906 | Ac-WVEHRLKGLLS[Cit]SGGVV[hArg]KNFVPTDVGPFAF-NH2 | 1.15 | 2.29 |
| 907 | Ac-WVEH[Cit]LKGLLS[Cit]SGGVV[hArg]KNFVPTDVGPFAF-NH2 | 0.83 | 4.87 |
| 908 | Ac-WVEH[hArg]LKGLLS[Cit]SGGVV[hArg]KNFVPTDVGPFAF-NH2 | 1.28 | |
| 909 | Ac-WVEH[hArg]LKGLLS[Cit]SG[Aze]VV[hArg]KNFVPTDVGPFAF-NH2 | 3.45 | |
| 910 | Ac-[1-Nal]VEH[hArg]LKGLLS[Cit]SG[Aze]VV[hArg]KNFVPTDVGPFAF-NH2 | 2.31 | |
| 911 | Ac-WVEH[Cit]LKGLLS[Cit]SGGVV[hArg]KNFVPTDVGPFAF-NH2 | 3.85 | |
| 912 | Ac-WVTHRLAGLLSRSGGVVRKN[2-Nal]VPTDVGPFAF-NH2 | 1.16 | |
| 913 | Ac-WVTHRLAGLLSRSGGVVRKNFVPTDVGPFA[2-Nal]-NH2 | 1.72 | |
| 914 | Ac-WVTHRLAGLLSRSGGVVRKNFVPTDVGPFA[1-Nal]-NH2 | 33.13 | |
| 915 | Ac-WVTHRLAGLLSRSGGVVRKNFVPTDVGSKAF-NH2 | 1.15 | |
| 916 | C[Ahx]WVTHRLAGLLSRSGGVVRKNFVPTDVGPFAF-NH2 | 1.8 | |
| 917 | Ac-WVTHRLAGLLSRSGGVVRKNFVPTDVGPKAF-NH2 | 1 | |
| 918 | Ac-WVTH[Cit]LAGLLS[Cit]SGGVVRKNFVPTDVGPKAF-NH2 | 1.48 | |
| 919 | Ac-WVTH[Cit]LAGLLS[Cit]SGGVXTRKNFV[Oic]TDVGPFAF-NH2 | 1.24 | |
| 920 | Ac-WVTH[Cit]LAGLLS[Cit]SGGVVRKNFVPTDVG[Oic]FAF-NH2 | 0.85 | |
| 921 | Ac-WVTH[Cit]LAGLLS[Cit]SGGVVRKNFV[Oic]TDVG[Oic]FAF-NH2 | 0.93 | |
| 922 | Ac-WVTH[Cit]LAGLLS[Cit]SGGVVRKN[pI-Phe]VPTDVGPFA[pI-Phe]-NH2 | 2.21 | |
| 923 | Ac-WVTH[Cit]LAGLLS[Cit]SGGVVRKNFVPTDVGPFA[pI-Phe]-NH2 | 2.24 | |
| 924 | Ac-WVTH[hArg]LAGLLS[Cit]SGGVV[hArg]KNFVPTDVGP[1-Nal]AF-NH2 | 2.18 | |
| 925 | Ac-WVTH[Cit]LAGLLS[Cit]SGGVV[hArg]KNFVPTDVGPFA[Phg]-NH2 | 6.78 | |
| 926 | Ac-WVTH[hArg]LAGLLS[Cit]SGGVV[hArg]KNFVPTDVGP[2-Nal]AF-NH2 | 0.88 | 2.39 |
| 927 | Ac-WVTH[Cit]LAGLLS[Cit]SGGVV[hArg]KNFVPTDVGP[1-Nal]AF-NH2 | 1.28 | 2.54 |
| 928 | Ac-WVTH[Cit]LAGLLS[Cit]SGGVV[hArg]KN[pI-Phe]VPTDVGP[pI-Phe]AF-NH2 | 1.16 | 11.4 |
| 929 | Ac-WVTH[Cit]LAGLLS[Cit]SGGVV[hArg]KNFVPTDVGP[Bip]AF-NH2 | 1.76 | 5.58 |
| 930 | Ac-WVTH[Cit]LAGLLS[Cit]SGGVV[hArg]KNFVPTDVGP[Igl]AF-NH2 | 4.58 | 126.3 |
| 931 | Ac-WVTH[Cit]LAGLLS[Cit]SGGVV[hArg]KNFVPTDVG[Oic]FAF-NH2 | 1.14 | 2.16 |
| 932 | Ac-WVTH[Cit]LAGLLS[Cit]SGGVV[hArg]KNFV[Oic]TDVG[Oic]FAF-NH2 | 1.31 | |
| 933 | Ac-WVTH[Cit]LAGLLS[Cit]SGGVV[hArg]KNFVPTDVG[Oic][1-Nal]AF-NH2 | 0.88 | |
| 934 | Ac-WVTH[Cit]LAGLLS[Cit]SGGVV[hArg]KNFVPTDVG[Oic][2-Nal]AF-NH2 | 1.65 | |
| 935 | Ac-WVTH[Cit]LAGLLS[hArg]SGGVV[Guf]KNFVPTDVGPFAF-NH2 | 2.37 | |
| 936 | Ac-WVTH[Cit]LAGLLS[hArg]SGGVV[BhArg]KNFVPTDVGPFAF-NH2 | 2.41 | |
| 937 | Ac-WVTH[Cit]LAGLLS[Cit]SGGVV[Cit]KNFVPTDVGPFAF-NH2 | 2.87 | |
| 938 | Ac-WVTH[Cit]LAGLLS[Cit]SGGVV[3G-Dpr]KNFVPTDVGPFAF-NH2 | 1.39 | |
| 939 | Ac-WVTH[Cit]LAGLLS[Cit]SGGVV[Guf]KNFVPTDVGPFAF-NH2 | 0.97 | 1.86 |
| 940 | Ac-WVTH[Cit]LAGLLS[Cit]SGGV[Nle]RKNFVPTDVGPFAF-NH2 | 1.85 | |
| 941 | Ac-WVTH[Cit]LAGLLS[Cit]SGGVV[hArg](30 KPEGald)NFVPTDVGPFAF-NH2 | | 7.76 |
| 942 | Ac-WVTH[hArg]LEGLLK[Cit]SGGVV[hArg]KNFVPTDVG[Oic]FAF-NH2 | 0.83 | |

TABLE 2C-continued

Additional exemplary CGRP peptide sequences, including N-terminally PEGylated. Underlined boldface amino acid residues, if any, indicate covalent cyclization between the first underlined boldface residue and the second underlined boldface residue in a sequence. If present, third and fourth underlined boldface amino acid residues in a sequence (in the N- to C-terminal direction) indicate cyclization between the third underlined boldface residue and the fourth underlined boldface residue. IC 50 values, if present, were determined as describe in Example 1 herein. In most cases in Table 2C the PEG conjugation site is at the Lys$^{25}$ residue relative to reference SEQ ID NO:43.

| SEQ ID NO | CGRP Peptide Sequence | Peptide IC50 (nM) | PEG-peptide IC50 (nM) |
|---|---|---|---|
| 943 | Ac-WVTH[Cit]LAGELS[Cit]KGGVV[hArg]KNFVPTDVG[Oic]FAF-NH2 | 1.45 | |
| 944 | Ac-WVTH[Cit]LAGELS[hArg]KGGVV[hArg]KNFVPTDVG [Oic][1-Nal]AF-NH2 | 0.85 | |
| 945 | Ac-KWVTH[Cit]LAGLLS[Cit]SGGVVRKNFVPTDVGPKAF-NH2 | 12.98 | |
| 946 | Ac-WVTH[Cit]LAGLLS[Cit]SGGVV[hArg]KNFVPTDVG[Tic]FAF-NH2 | 2.47 | |
| 947 | Ac-WVTH[Cit]LAGLLS[Cit]SGGVV[hArg]KNFVPTDVGP[Tic]AF-NH2 | 89.91 | |
| 948 | Ac-WVTH[Cit]LAGLLS[Cit]SGGVV[hArg]KNFV[Oic]TDVG[Oic]FA[2-Nal]-NH2 | 2.57 | |
| 949 | Ac-WVTH[Cit]LAGLLS[Cit]SGGVV[hArg]KNFV[Oic]TDVGP[1-Nal]A[2-Nal]-NH2 | 2.73 | |
| 950 | Ac-WVTH[Cit]LAGLLS[Cit]SGGVV[hArg]KNFV[Oic]TDVGP[Bip]AF-NH2 | 3.85 | |
| 951 | Ac-WVTH[Cit]LAGLLS[Cit]SGGVV[hArg]KNFV[Oic]TDVGPFA[2-Nal]-NH2 | 3.22 | |
| 952 | Ac-WVTH[Cit]LAGLLS[Cit]SGGVV[hArg]KN[pI-Phe]V[Oic]TDVGP[pI-Phe]AF-NH2 | 2.34 | |
| 953 | Ac-WVTH[Cit]LAGLLs[Cit]SGGVV[hArg]KN[2-Nal]VPTDVG[Oic]FAF-NH2 | 2.66 | |
| 954 | Ac-WVTH[Cit]LAGLLS[Cit]SGGVV[hArg]KN[2-Nal]VPTDVG[Oic]FA[2-Nal]-NH2 | 3.45 | |
| 955 | Ac-WVTH[Cit]LAGLLS[Cit]SGGVV[hArg]KN[2-Nal]V[Oic]TDVG[Oic]FA[2-Nal]-NH2 | 3.57 | |
| 956 | Ac-WVTH[Cit]LAGLLS[Cit]SGGVVRKNFVPTDVG[Tic]FAF-NH2 | 3.02 | |
| 957 | Ac-WVTH[Cit]LAGLLS[Cit]SGGVVRKNFVPTDVG[Tic]FAF-NH2 | 4.32 | |
| 958 | Ac-WVTH[Cit]LAGLLS[Cit]SGGVV[hArg]KNFVPTDVG[Tic]FAF-NH2 | 19.7 | |
| 959 | Ac-WVTH[Cit]LAGLLS[Cit]SGGVV[hArg]KNFVPTDVG[Tic]FAF-NH2 | 8.85 | |
| 960 | Ac-WVTH[Cit]LAGLLS[Cit]SGGVV[hArg]KNFVPTDVGP[1-Nal]AF-NH2 | 2.24 | |
| 961 | Ac-WVTH[Cit]LAGLLS[Cit]SGGVV[hArg]KNFVPTDVG[Oic]FAF-NH2 | 4.04 | |
| 962 | Ac-WVTH[Cit]LAGLLS[Cit]SGGVVRKNFVPTDVGP[Tic]AF-NH2 | 10.13 | |
| 963 | Ac-WVTH[Cit]LAGLLS[Cit]SGGVV[hArg]KNFVPTDVG[Tiq]FAF-NH2 | | |
| 964 | Ac-WVTH[Cit]LAGLLS[Cit]SGGVV[hArg]KNFVPTDVGP[Tiq]AF-NH2 | | |
| 965 | Ac-WVTH[Cit]LAGLLS[Cit]SGGVV[Guf]KNFVPTDVG[Oic]FAF-NH2 | | |
| 966 | Ac-WVTH[Cit]LAGLLS[Cit]SGGVVRKNFVPTDVGPKAFK-NH2 | | |
| 967 | Ac-WVTH[Cit]LAGLLS[Cit]SGGVV[Guf]KNFVPTDVG[Oic]FAF-NH2 | | |
| 968 | Ac-WVTH[Cit]LAGLLS[Cit]SGGVV[hArg]KNFVPTDVG[1-Nal]AF-NH2 | | |
| 969 | Ac-WVTH[Cit]LAGLLS[Cit]SGGVV[hArg]KNFVPTDVG[Tiq]FAFF-NH2 | | |
| 970 | Ac-WVTH[Cit]LAGLLS[Cit]SGGVV[hArg]KNFVPTDVG[Tiq]AFF-NH2 | | |
| 971 | Ac-WVTH[Cit]LAGLLS[Cit]SGGVV[hArg]KNFVPTDVG[Thz]FAF-NH2 | | |
| 972 | Ac-WVTH[Cit]LAGLLS[Cit]SGGVV[hArg]KNFVPTDVG[Phg]FAF-NH2 | | |
| 973 | Ac-WVTH[Cit]LAGLLS[Cit]SGGVV[hArg]KNFVPTDVG[Pip]FAF-NH2 | | |
| 974 | Ac-WVTH[Cit]LAGLLS[Cit]SGGVV[hArg]KNFVPTDVG[Hyp]FAF-NH2 | | |
| 975 | Ac-WVTH[Cit]LAGLLS[Cit]SGGVV[hArg]KNFVPTDVG[Nip]FAF-NH2 | | |
| 976 | Ac-WVTH[Cit]LAGLLS[Cit]SGGVV[hArg]KNFVPTDVG[Aic]FAF-NH2 | | |
| 977 | Ac-WVTH[Cit]LAGLLS[Cit]SGGVV[hArg]KNFVPTDVG[Aib]FAF-NH2 | | |
| 978 | Ac-WVTH[Cit]LAGLLS[Cit]SGGVV[hArg]KNFVPTDVG[Hyp][1-Nal]AF-NH2 | | |
| 979 | Ac-WVTH[Cit]LAGLLS[Cit]SGGVV[hArg]KNFVPTDVG[Pip][1-Nal]AF-NH2 | | |
| 980 | Ac-WVTH[Cit]LAGLLS[Cit]SGGVV[hArg]KNFVPTDVG[Sar]FAF-NH2 | | |
| 981 | Ac-WVTH[Cit]LAGLLS[Cit]SGGVVRKNFVPTDVGP[Tic]AF-NH2 | | |
| 982 | Ac-WVTH[Cit]LAGLLS[Cit]SGGVV[hArg]KNFVPTDVG[Tpi]FAF-NH2 | | |
| 983 | Ac-WVTH[Cit]LAGLLS[Cit]SGGVV[hArg]KNFVPTDVGP[Tpi]AF-NH2 | | |
| 984 | Ac-WVTH[Cit]LAGLLS[Cit]SGGVV[Cit]KNFVPTDVG[Oic]KAF-NH2 | | |
| 985 | Ac-WVTH[Guf]LAGLLS[Cit]SGGVV[Guf]KNFVPTDVG[Oic]FAF-NH2 | | |
| 986 | Ac-WVTH[Guf]LAGLLS[Guf]SGGVV[Cit]KNFVPTDVG[Oic]FAF-NH2 | | |
| 987 | Ac-WVTH[Cit]LAGELS[hArg]KGGVV[Guf]KNFVPTDVG[Oic]FAF-NH2 | | |
| 988 | Ac-WVTH[Cit]LAGELS[hArg]KGGVV[Guf]KNFV[Oic]TDVG[Oic]FAF-NH2 | | |
| 989 | Ac-WVTH[Cit]LAGLLS[Cit]SGGVV[hArg]KNFVPTDVG[Thz]FAF-NH2 | | |
| 990 | Ac-WVTH[Cit]LAGLLS[Cit]SGGVV[hArg]KNFVPTDVGP[Tpi]AF-NH2 | | |
| 991 | Ac-WVTH[Cit]LAGLLS[Cit]SGGVV[hArg]KNFVPTDVG[Oic]FAF-NH2 | | |
| 992 | Ac-WVTH[Cit]LAGLLS[Cit]SGGVV[hArg]KNFVPTDVG[1-Nal]AF-NH2 | | |
| 993 | Ac-WVTH[Cit]LAGLLS[Cit]SGGVV[hArg]KNFVPTDVG[1-Nal]AF-NH2 | | |
| 994 | Ac-WVTH[Cit]LAGELS[Cit]KGGVV[hArg]KNFVPTDVGP[1-Nal]AF-NH2 | | |
| 995 | Ac-WVTH[Cit]LAGELS[hArg]KGGVV[Guf]KNFVPTDVG[Oic]FAF-NH2 | | |
| 996 | Ac-WVTH[Cit]LAGELS[hArg]KGGVV[Guf]KNFV[Oic]TDVG [Oic]FAF-NH2 | | |
| 997 | Ac-WVEH[Cit]LKGELS[Cit]KGGC-NH2 | | |
| 998 | Ac-WVEH[Cit]LKGLLS[Cit]SGGC-NH2 | | |
| 999 | Ac-WVTH[Cit]LEGLLK[Cit]SGGC-NH2 | | |
| 1000 | Ac-WVTH[Cit]LAGELS[Cit]KGGC-NH2 | | |
| 1001 | CGGPTDVG[Oic][1-Nal]AF-NH2 | | |
| 1002 | CGGPTDVG[Oic][2-Nal]AF-NH2 | | |
| 1003 | CGGPTDVG[Oic][2-Nal]A[2-Nal]-NH2 | | |

TABLE 2C-continued

Additional exemplary CGRP peptide sequences, including N-terminally PEGylated. Underlined boldface amino acid residues, if any, indicate covalent cyclization between the first underlined boldface residue and the second underlined boldface residue in a sequence. If present, third and fourth underlined boldface amino acid residues in a sequence (in the N- to C-terminal direction) indicate cyclization between the third underlined boldface residue and the fourth underlined boldface residue. IC 50 values, if present, were determined as describe in Example 1 herein. In most cases in Table 2C the PEG conjugation site is at the Lys[25] residue relative to reference SEQ ID NO:43.

| SEQ ID NO | CGRP Peptide Sequence | Peptide IC50 (nM) | PEG-peptide IC50 (nM) |
|---|---|---|---|
| 1004 | CGGPTDVGP[1-Nal]AF-NH2 | | |
| 1005 | CGGPTDVGP[2-Nal]AP-NH2 | | |
| 1006 | CGGPTDVG[Oic]FA F-NH2 | | |
| 1007 | CGG[Oic]TDVG[Oic]FAF-NH2 | | |
| 1008 | Ac-WVTH[Cit]LAGLLS[Cit]SGGVV[hArg]K(NPeg11)KFVPTDVG[Oic]K(NPeg11)AF-NH2 | | |
| 1009 | [NPeg11]WVTH[Cit]LAGLLS[Cit]SGGVV[hArg]KNFVPTDVG[Oic]KAF-NH2 | | |
| 1010 | Ac-WVTH[Cit]LAGLLS[Cit]SGGVV[hArg]KN[Guf]VPTDVG[Oic]KAF-NH2 | | |
| 1011 | [Gaun][NPeg11]WVTH[Cit]LAGLLS[Cit]SGGVV[hArg]KNFVPTDVG[Oic]KAF-NH2 | | |
| 1012 | Ac-WVTH[Cit]LAGLLS[Cit]SGGVV[Cit]K(NPeg11)KFVPTNVG[Oic]K(NPeg11)AF-NH2 | | |
| 1013 | Ac-WVTH[Cit]LAGLLS[Cit]SGGVV[Cit]K(NPeg11)KFVPTDVG[Oic]K(NPeg11)AF-NH2 | | |
| 1014 | Ac-WVTH[Cit]LAGLLS[Cit]SGGVV[Cit]K(NPeg11)KFVPTNVG[Oic]KAF-NH2 | | |
| 1015 | Ac-WVTH[Cit]LAGLLS[Cit]SGGVV[hArg]KKVPTDVG[Oic]KAF-NH2 | | |
| 1016 | Ac-WVTh[Cit]LAGLLS[Cit]SGGVV[hArg]KKFVPTDVG[Oic]KAF-NH2 | | |
| 1017 | [NPeg11]WVTH[Cit]LAGLLS[Cit]SGGVV[hArg]KNFVPTDVG[Oic]KAF-NH2 | | |
| 1018 | Ac-WVTH[Cit]LAGLLS[Cit]SGGVV[hArg]KN[Guf]VPTDVG[Oic]KAF-NH2 | | |
| 1019 | [Gaun][NPeg11]WVTH[Cit]LAGLLS[Cit]SGGVV[hArg]KNFVPTDVG [Oic]KAF-NH2 | | |
| 1020 | Ac-WVTH[Cit]LAGLLS[Cit]SGGVV[Cit]KKFVPTNVG[Oic]KAF-NH2 | | |
| 1021 | Ac-WVTH[Cit]LAGLLS[Cit]SGGVV[Cit]KKFVPTDVG[Oic]KAF-NH2 | | |
| 1022 | Ac-WVTH[Cit]LAGLLS[Cit]SGGVV[Cit]KKFVPTNVG[Oic]KAF-NH2 | | |
| 1023 | Ac-WVTH[Cit]LAGLLS[Cit]SGGVV[hArg]K(NPeg11)NFVPTDVG[Oic]FAF-NH2 | | |
| 1024 | Ac-WVTH[Cit]LAGLLS[Cit]SGGVV[Cit]K(NPeg11)NFVPTDVG[Oic]FAF-NH2 | | |
| 1025 | Ac-WVTH[Cit]LAGLLS[Cit]SGGVV[Oic]K(NPeg11)NFVPTDVG[Oic]KAF-NH2 | | |
| 1026 | Ac-WVTH[Cit]LAGLLS[Cit]SGGVV[Cit]K(NPeg11)NFVPTNVG[Oic]KAF-NH2 | | |
| 1027 | Ac-WVTH[Cit]LAGLLS[Cit]SGGVV[hArg]KNFVPTDVG[Oic]KA[Guf]-NH2 | | |
| 1028 | Ac-WVTH[Cit]LAGLLS[Cit]SGGVV[hArg]KNFVPTDVG[Oic]FAF-NH2 | | |
| 1029 | Ac-WVTH[Cit]LAGLLS[Cit]SGGVV[hArg]KKEVPTNVG[Oic]KAF-NH2 | | |
| 1030 | Ac-WVTH[Cit]LAGLLS[Cit]SGGVV[hArg]KKFVPTDVG[Oic]KAF-NH2 | | |
| 1031 | Ac-WVTH[Cit]LAGLLS[Cit]SGGVV[Cit]KNFVPTDVG[Oic]KAF-NH2 | | |
| 1032 | Ac-WVTH[Cit]LAGLLS[Cit]SGGVV[Cit]KNFVPTDVG[Oic]FAF-NH2 | | |
| 1033 | Ac-WVTH[Cit]LAGLLS[Cit]SGGVV[Cit]KNFVPTDVGP[1-Nal]AF-NH2 | | |
| 1034 | Ac-R(BocBoc)KNFVPTD(tBu)VG[Oic]K(Boc)AF-NH2 | | |
| 1035 | R(BocBoc) KNFVPTD(tBu)VG[Oic]K(Boc)AF-NH2 | | |
| 1036 | Ac-R(BocBoc)KK(Boc)FVPTD(tBu)VG[Oic]KAF-NH2 | | |
| 1037 | Ac-R(BocBoc)KK(Boc)FVPTNVG[Oic]KAF-NH2 | | |
| 1038 | Ac-R(BocBoc)R(BocBoc)KNFVPTD(tBU)VG[Oic]KAF-NH2 | | |
| 1039 | Ac-RK(Cys)KPVPTDVG[Oic]KAF-NH2 | | |
| 1040 | RK(Cys)KFVPTDVG[Oic]KAF-NH2 | | |
| 1050 | RK(Cys)NFVPTDVG[Oic]KAF-NH2 | | |
| 1051 | RK(Cys)KFVPTNVG[Oic]KAF-NH2 | | |
| 1052 | [Cit]LAGLLS[Cit]SGGVVRKNFVPTDVG[Oic]FAF-NH2 | | |
| 1053 | LAGLLS[Cit]SGGVVRKNFVPTDVG[Oic]FAF-NH2 | | |
| 1054 | AGLLS[Cit]SGGVVRKNFVPTDVG[Oic]FAF-NH2 | | |
| 1055 | GLLS[Cit]SGGVVRKNFVPTD VG[Oic]FAF-NH2 | | |
| 1056 | LLS[Cit]SGGVVRKNFVPTD VG[Oic]FAF-NH2 | | |
| 1057 | LS[Cit]SGGVVRKNFVPTD VG[Oic]FAF-NH2 | | |
| 1058 | S[Cit]SGGVVRKNFVPTD VG[Oic]FAF-NH2 | | |
| 1059 | [Cit]SGGVVRKNFVPTD VG[Oic]FAF-NH2 | | |
| 1060 | SGGVVRKNFVPTDVG[Oic]FAF-NH2 | | |
| 1061 | GGVVRKNFVPTDVG[Oic]FAF-NH2 | | |
| 1062 | VVRKNFVPTDVG[Oic]FAF-NH2 | | |
| 1063 | Ac-EVTHKLAGLLS[Cit]SGGVV[hArg]KNFVPTDVG[Oic]FAF-NH2 | | |
| 1064 | Ac-WETH[Cit]KAGLLS[Cit]SGGVV[hArg]KNFVPTDVG[Oic]FAF-NH2 | | |
| 1065 | Ac-WVEH[Cit]LKGLLS[Cit]SGGVV[hArg]KNFVPTDVG[Oic]FAF-NH2 | | |
| 1066 | Ac-WVTE[Cit]LAKLLS[Cit]SGGVV[hArg]KNFVPTDVG[Oic]FAF-NH2 | | |
| 1067 | Ac-WVTHELAGKLS[Cit]SCCVV[hArg]KNFVPTDVC[Oic]FAF-NH2 | | |
| 1068 | Ac-WVTH[Cit]EAGLKS[Cit]SGGVV[hArg]KNFVPTDVG[Oic]FAF-NH2 | | |
| 1069 | Ac-WVTH[Cit]LEGLLK[Cit]SGGVV[hArg]KNFVPTDVG[Oic]FAF-NH2 | | |
| 1070 | Ac-WVTH[Cit]LAELLSKSGGVV[hArg]KNFVPTDVG[Oic]FAF-NH2 | | |
| 1071 | Ac-WVTH[Cit]LAGELS[Cit]KGGVV[hArg]KNFVPTDVG[Oic]FAF-NH2 | | |
| 1072 | Ac-WVTH[Cit]LAGLES[Cit]SKGVV[hArg]KNFVPTDVG[Oic]FAF-NH2 | | |

TABLE 2C-continued

Additional exemplary CGRP peptide sequences, including N-terminally PEGylated. Underlined boldface amino acid residues, if any, indicate covalent cyclization between the first underlined boldface residue and the second underlined boldface residue in a sequence. If present, third and fourth underlined boldface amino acid residues in a sequence (in the N- to C-terminal direction) indicate cyclization between the third underlined boldface residue and the fourth underlined boldface residue. IC 50 values, if present, were determined as describe in Example 1 herein. In most cases in Table 2C the PEG conjugation site is at the Lys$^{25}$ residue relative to reference SEQ ID NO:43.

| SEQ ID NO | CGRP Peptide Sequence | Peptide IC50 (nM) | PEG-peptide IC50 (nM) |
|---|---|---|---|
| 1073 | Ac-WVTH[Cit]LAGLLE[Cit]SGKVV[hArg]KNFVPTDVG[Oic]FAF-NH2 | | |
| 1074 | Ac-WVTH[Cit]LAGLLSESGGKV[hArg]KNFVPTDVG[Oic]FAF-NH2 | | |
| 1075 | Ac-WVTH[Cit]LAGLLS[Cit]EGGVK[hArg]KNFVPTDVG[Oic]FAF-NH2 | | |
| 1076 | Ac-WVTH[Cit]LAGLLS[Cit]SGEVV[hArg]KNFVPTDVG[Oic]FAF-NH2 | | |
| 1077 | Ac-WVTH[Cit]LAGLLS[Cit]SGGEV[hArg]KKFVPTDVC[Oic]FAF-NH2 | | |
| 1078 | Ac-WVTH[Cit]LAGLLS[Cit]SGGVV[hArg]KKFVPTDVG[Oic]FAF-NH2 | | |
| 1079 | Ac-WVTH[Cit]LAGLLS[Cit]SGGVV[hArg]KNKVPTDDG[Oic]FAF-NH2 | | |
| 1080 | Ac-WVTH[Cit]LAGLLS[Cit]SGGVV[hArg]KNFKPTDVD[Oic]FAF-NH2 | | |
| 1081 | Ac-WVTH[Cit]LAGLLS[Cit]SGGVV[hArg]KNFVPKDVG[Oic]DAF-NH2 | | |
| 1082 | Ac-WVTH[Cit]LAGLLS[Cit]SGGVV[hArg]KNFVPTKVG[Oic]FDF-NH2 | | |
| 1083 | Ac-WVTH[Cit]LAGLLS[Cit]SGGVV[hArg]KNFVPTDKG[Oic]FAD-NH2 | | |
| 1084 | Ac-WVTH[Cit]LAGLLS[Cit]SGGVV[Cit]KNFVPTDVG[Oic]FAF-NH2 | | |
| 1085 | Ac-WVTH[Cit]LAGLLS[Cit]SGGVV[Cit]K(NPeg11)NFVPTDVG[Oic]FAF-NH2 | | |
| 1086 | Ac-WVTH[Cit]LAGLLS[Cit]SGGVV[hArg]K(NPeg11)NFVPTNVG[Oic]FAF-NH2 | | |
| 1087 | Ac-WVTH[Cit]LAGLLS[Cit]SGGVV[Cit]KNFVPTDVGP[1-Nal]AF-NH2 | | |
| 1088 | Ac-WVTH[Cit]LAGLLs[Cit]SGGVV[hArg]KNFVPTDVG[Oic]FAF-NH2 | | |
| 1089 | Ac-WVTH[Cit]LAGLLS[Cit]SGGVV[hArg]KNFVPTDVG[BhPro]FAF-NH2 | | |
| 1090 | Ac-WVTH[Cit]LAGLLS[Cit]SGGVV[BhArg]KNFVPTDVG[Oic]FAF-NH2 | | |
| 1091 | Ac-WVTH[Cit]LAGLLS[Cit]SGGVV[hArg]KNFVPTDVG[Oic][BhPhe]AF-NH2 | | |
| 1092 | Ac-WVTH[Cit]LAGLLS[Cit]SGGVV[hArg]KN[BhPhe]VPTDVG[Oic]FAF-NH2 | | |
| 1093 | Ac-WVTH[Cit]LAGLLS[Cit]SGGVV[hArg]KN[AMeF]VPTD VG[Oic]FAF-NH2 | | |
| 1094 | Ac-WVTH[Cit]LAGLLS[Cit]SGGVV[hArg]KNFVPTDVG[Oic]FA[AMeF]-NH2 | | |
| 1095 | Ac-WVTH[Cit]LAGLLS[Cit]SGGVV[hArg]KNFVPTDVG[Oic][AMeF]AF-NH2 | | |
| 1096 | Ac-WVTh[Cit]LAGLLS[Cit]SGGVV[hArg]KN[NMePhe]VPTDVG[Oic]FAF-NH2 | | |
| 1097 | Ac-WVTH[Cit]LAGLLS[Cit]SGGVV[hArg]KNFVPTDVG[Oic]FA[NMePhe]-NH2 | | |
| 1098 | Ac-WVTH[Cit]LAGLLS[Cit]SGGVV[hArg]KNFVPTDVG[Oic][NMePhe]AF-NH2 | | |
| 1099 | Ac-WVTH[Cit]LAGLLS[Cit]SGGVV[hArg]KNFVPTDVG[Nip]FAF-NH2 | | |
| 1100 | RK(Cys)NFVPTDVG[Oic]FAF-NH2 | | |
| 1101 | RRK(Cys)NFVPTDVG[Oic]FAF-NH2 | | |
| 1102 | Ac-WVTH[Cit]LAGLLS[Cit]SGGVV[hArg]K(NPeg11)NFVPTNVG[Oic]FAF-NH2 | | |
| 1103 | Ac-WVTH[Cit]LAGLLS[Cit]SGGVV[hArg]K(NPeg11)NFVPTNVGp[1-Nal]AF-NH2 | | |

TABLE 2D

Additional exemplary CGRP peptide sequences, including N-terminally PEGylated. Underlined boldface amino acid residues, if any, indicate cyclization between the first underlined boldface residue and the second underlined boldface residue in a sequence. Groups shown in parenteses and superscript are related to the residue on its left (typically Lys or Cys), and indicate attachment through the side chain group. IC50 values were determined as describe in Example 1 herein.

| SEQ ID NO | Sequence | IC50 (nM) |
|---|---|---|
| 764 | Ac-WVTHRLAGLLSRSGGVVRCNFVPTDVGPFAF-amide | 0.91 |
| 765 | Ac-WVTHRLAGLLSRSGGVVRC$^{(5\ kDa\ MeO\text{-}PEG)}$NFVPTDVGPFAF-amide | 2.52 |
| 766 | Ac-WVTHRLAGLLSRSGGVVRC$^{(20\ kDa\ MeO\text{-}PEG)}$NFVPTDVGPFAF-amide | 4.09 |
| 767 | Ac-WVTHRLAGLLSRSGGVVRC$^{(30\ kDa\ MeO\text{-}PEG)}$NFVPTDVGPFAF-amide | 7.86 |
| 768 | Ac-WVTHRLAGLLSRSGGVVRC$^{(20\ kDa\ branched\ MeO\text{-}PEG_2)}$NFVPTDVGPFAF-amide | 23.80 |
| 769 | Ac-WVTHRLAGLLSRSGGVVRC$^{(40\ kDa\ branched\ MeO\text{-}PEG_2)}$NFVPTDVGPFAF-amide | 33.40 |
| 770 | -Ac-WVTHRLAGLLSRSGGVVRC$^{(20\ kDa\ branched\ MeO\text{-}PEG_2)}$NFVPTDVGPFAF-amide | 0.17 |

TABLE 2D-continued

Additional exemplary CGRP peptide sequences, including N-terminally PEGylated. Underlined boldface amino acid residues, if any, indicate cyclization between the first underlined boldface residue and the second underlined boldface residue in a sequence. Groups shown in parenteses and superscript are related to the residue on its left (typically Lys or Cys), and indicate attachment through the side chain group. IC50 values were determined as describe in Example 1 herein.

| SEQ ID NO | Sequence | IC50 (nM) |
|---|---|---|
| 771 | Ac-WVTHRLAGLLSRSGGVVRC$^{(20\ kDa\ NEM-PEG)}$NFVPTDVGPFAF-amide | 0.30 |
| 772 | Ac-WVTHRLAGLLS[A]SGGVVRCNFVPTDVGPFAF-amide | 2.75 |
| 773 | Ac-WVTHRLAGLLSASGGVVRC$^{(20\ kDa\ MeO-PEG)}$NFVPTDVGPFAF-amide | 6.20 |
| 774 | Ac-WVTHRLAGLLS[Q]SGGVVRC$^{(20\ kDa\ MeO-PEG)}$NFVPTDVGPEAF-amide | 0.37 |
| 775 | Ac-WVTHRLAGLLSQSGGVVRC$^{(20\ kDa\ MeO-PEG)}$NFVPTDVGPFAF-amide | 4.69 |
| 776 | Ac-WVTHRLAGLLS[r]SGGVVRCNFVPTDVGPFAF-amide | 0.59 |
| 777 | Ac-WVTHRLAGLLS[r]SGGVVRC$^{(20\ kDa\ MeO-PEG)}$NFVPTDVGPFAF-amide | 19.42 |
| 778 | Ac-[3IPA]-VTHRLAGLLSRSGGVVRCNFVPTDVGPFAF-amide | 0.35 |
| 779 | Ac-[3IPA]-VTHRLAGLLSRSGGVVRC$^{(20\ kDa\ MeO-PEG)}$NFVPTDVGPFAF-amide | 2.22 |
| 780 | Ac-WVTHRLAGLLSRSGGVVRCNFVPTDVGPFAF-amide | |
| 781 | (Trivalent 20 kDa PEG-Cys$^{25}$ linked[Ac-WVTHRLAGLLSRSGGVVRC$^{25}$NFVPTDVGPFAF-amide]$_3$ | 0.19 |
| 782 | (Tetravalent 20 kDa PEG-Cys$^{25}$ linked[Ac-WVTHRLAGLLSRSGGVVRC$^{25}$NFVPTDVGPFAF-amide]$_4$ | 0.08 |
| 783 | (Octavalent 20 kDa PEG-Cys$^{25}$ linked[Ac-WVTHRLAGLLSRSGGVVRC$^{25}$NFVPTDVGPFAF-amide]$_8$ | 1.40 |
| 784 | Ac-WVTH[hArg]LAGLLS[hArg]SGGVVRKNFVPTDVGPFAF-amide | 2.10 |
| 785 | Ac-WVTH[hArg]LAGLLS[hArg]SGGVVRK$^{(20\ kDa\ MeO-PEG)}$NFVPTDVGPFAF-amide | 0.37 |
| 786 | Ac-WVTHRLAGLLS[hArg]SGGVVRKNFVPTDVGPFAF-amide | 0.57 |
| 787 | Ac-WVTHRLAGLLS[hArg]SGGVVRK$^{(20\ kDa\ MeO-PEG)}$NFVPTDVGPFAF-amide | 0.33 |
| 788 | Ac-WVTH[hArg]LAGLLSRSGGVVRKNFVPTDVGPFAF-amide | 0.44 |
| 789 | Ac-WVTH[hArg]LAGLLSRSGGVVRK$^{(20\ kDa\ MeO-PEG)}$NFVPTDVGPFAF-amide | 0.36 |
| 790 | Ac-WVTH[Cit]LAGLLS[Cit]SGG VVRKNFVPTDVGPFAF-amide | 1.70 |
| 791 | Ac-WVTH[Cit]LAGLLS[Cit]SGG VVRK$^{(20\ kDa\ MeO-PEG)}$NFVPTDVGPFAF-amide | 3.74 |
| 792 | Ac-WVTH[Cit]LAGLLS[Cit]SGG VVRK$^{(20\ kDa\ MeO-PEG)}$NFVPTDVGPFAF-amide | |
| 793 | Ac-WVTH[Cit]LAGLLS[Cit]SGG VVRK$^{(20\ kDa\ MeO-PEG)}$NFVPTDVGPFAF-amide | |
| 794 | 2Ac-WVTH[Cit]LAGLLS[Cit]SGG VVRK$^{(20\ kDa\ MeO-PEG)}$NFVPTDVGPFAF-amide | |
| 795 | Ac-WVTH[Cit]LAGLLS[Cit]SGG VVRK$^{(20\ kDa\ MeO-PEG)}$NFVPTDVGPFAF-amide | |
| 796 | Ac-WVTHRLAGLLS[Cit]SGG VVRKNFVPTDVGPFAF-amide | 0.58 |
| 797 | Ac-WVTHRLAGLLS[Cit]SGG VVRK$^{(20\ kDa\ MeO-PEG)}$NFVPTDVGPFAF-amide | 0.96 |
| 798 | Ac-WVTH[Cit]LAGLLSRSGGV VRKNFVPTDVGPFAF-amide | 0.57 |
| 799 | Ac-WVTH[Cit]LAGLLSRSGGV VRK$^{(20\ kDa\ MeO-PEG)}$NFVPTDVGPFAF-amide | 2.08 |
| 800 | Ac-WVTHRLAGLLSRSGGVVRN[C]FVPTDVGPFAF-amide | |
| 801 | Ac-WVTHRLAGLLSRSGGVVRNC$^{(20\ kDa\ MeO-PEG)}$FVPTDVGPFAF-amide | 1.64 |
| 802 | $^{13}C_{1,2}$Ac-WVTHRLAGLLSRSGG VVRKNFVPTDVGPFA[15N-F]-amide | |
| 803 | $^{13}C_{1,2}$Ac--WVTHRLAGLLSRSGG VVRK$^{(20\ kDa\ MeO-Peg)}$NFVPTDVGPFA[15N-F]-amide | 3.28 |

TABLE 2D-continued

Additional exemplary CGRP peptide sequences, including N-terminally PEGylated. Underlined boldface amino acid residues, if any, indicate cyclization between the first underlined boldface residue and the second underlined boldface residue in a sequence. Groups shown in parenteses and superscript are related to the residue on its left (typically Lys or Cys), and indicate attachment through the side chain group. IC50 values were determined as describe in Example 1 herein.

| SEQ ID NO | Sequence | IC50 (nM) |
|---|---|---|
| 804 | Ac-WVTHRLAGLLSRSGGVVRCNFVPTDVGPFAF-amide | |
| 805 | Ac-WVTHRLAGLLSRSGGVVRC $^{(20\ kDa\ MeO-PEG)}$NFVPTDVGPFAF-amide | 1.33 |
| 806 | Ac-WVTHRLAGLLSRSGGVVRKNFVPTDVGPFAF-amide | |
| 807 | Ac-WVTHRLAGLLSRSGGVVRK $^{(20\ kDa\ MeO-PEG\ amide)}$NFVPTDVGPFAF-amide | |
| 808 | Ac-WVTHRLAGLLSRSGGVVRKNFVPTDVGPFAF-amide | |
| 809 | Ac-WVTHRLAGLLSRSGGVVRK $^{(20\ kDa\ MeO-PEG)}$NFVPTDVGPFAF-amide | 0.32 |
| 810 | Ac-WVTHRLAGLLSRSGGVVRK $^{(20\ kDa\ MeO-PEG)}$NFVPTDVGPFAF-amide | |
| 811 | Ac-WVTHRLAGLLSRSGGVVRK $^{(20\ kDa\ MeO-PEG)}$NFVPTDVGPFAF-amide | |
| 812 | Ac-WVTHRLAGLLSRSGGVVRK $^{(20\ kDa\ MeO-PEG)}$NFVPTDVGPFAF-amide | |
| 813 | Ac-WVTHRLAGLLSRSGGVVRK $^{(20\ kDa\ MeO-PEG)}$NFVPTDVGPFAF-amide | |
| 814 | Ac-WVTHRLAGLLS[Q]SGGVVRKNFVPTDVGPFAF-amide | 0.47 |
| 815 | Ac-WVTHRLAGLLS[Q]SGGVVRK $^{(20\ kDa\ MeO-PEG)}$NFVPTDVGPFAF-amide | 0.46 |
| 816 | Ac-WVTH[Q]LAGLLS[Q]SGGVVRKNFVPTDVGPFAF-amide | 0.53 |
| 817 | Ac-WVTH[Q]LAGLLS[Q]SGGVVRK $^{(20\ kDa\ MeO-PEG)}$NFVPTDVGPFAF-amide | 5.24 |
| 818 | Ac-WVTH[Q]LAGLLS[Q]SGGVVRK $^{(20\ kDa\ MeO-PEG)}$NFVPTDVGPFAF-amide | 7.18 |
| 819 | Ac-WVTH[Q]LAGLLS[Q]SGGVVRK $^{(20\ kDa\ MeO-PEG)}$NFVPTDVGPFAF-amide | |
| 820 | Ac-WVTHRLAGLLSRSGGV[C]RNNFVPTDVGPFAF-amide | 0.36 |
| 821 | Ac-WVTHRLAGLLSRSGGVC $^{(20\ kDa\ MeO-PEG)}$RNNFVPTDVGPFAF-amide | 0.16 |
| 822 | Ac-WVTHRLAGLLSRSGGVC $^{(20\ kDa\ MeO-PEG)}$RNNFVPTDVGPFAF-amide | |
| 823 | Ac-'WVTHRLAGLLSRSGGVKRNNFVPTDVGPFAF-amide | 0.51 |
| 824 | Ac-'WVTHRLAGLLSRSGGVK $^{(20\ kDa\ MeO-PEG)}$RNNFVPTDVGPFAF-amide | 0.98 |
| 825 | Ac-WVTHRLAGLLSRSGGVVRCNFVPTDVGPFAF-amide | |
| 826 | Ac-WVTHRLAGLLSRSGGVVRC $^{(20\ kDa\ MeO-PEG)}$NFVPTDVGPFAF-amide | |
| 827 | Ac-WVTHRLAGLLSRSGGVVRC $^{(20\ kDa\ MeO-PEG)}$NFVPTDVGPFAF-amide | |
| 828 | Ac-'WVTHRLAGLVSQSGGVCRNNFVPTDVGPFAF-amide | |
| 829 | -Ac-'WVTHRLAGLVSQSGGVC $^{(20\ kDa\ MeO-PEG)}$RNNFVPTDVGPFAF-amide | |
| 830 | Ac-WVTHRLAGL[Nva]SQSGGVCRNNFVPTDVGPFAF-amide | |
| 831 | Ac-WVTHRLAGL[Nva]SQSGGVC $^{(20\ kDa\ MeO-PEG)}$RNNFVPTDVGPFAF-amide | |
| 832 | Ac-WVTHQLAGLVSQSGGVCRNNFVPTDVGPFAF-amide | |
| 833 | Ac-WVTHQLAGL[Nva]SQSGGVCRNNFVPTDVGPFAF-amide | |
| 834 | Ac-WVTHQLAGL[Nva]SQSGGVC $^{(20\ kDa\ MeO-PEG)}$RNNFVPTDVGPFAF-amide | |
| 835 | Ac-WVTHRLAGLVS[Cit]SGGVCRNNFVPTDVGPFAF-amide | |
| 836 | -Ac-WVTHRLAGLVS[Cit]SGGVC $^{(20\ kDa\ MeO-PEG)}$RNNFVPTDVGPFAF-amide | |
| 837 | Ac-WVTHRLAGL(Nva)S[Cit]SGGVCRNNFVPTDVGPFAF-amide | |

TABLE 2D-continued

Additional exemplary CGRP peptide sequences, including N-terminally PEGylated. Underlined boldface amino acid residues, if any, indicate cyclization between the first underlined boldface residue and the second underlined boldface residue in a sequence. Groups shown in parenteses and superscript are related to the residue on its left (typically Lys or Cys), and indicate attachment through the side chain group. IC50 values were determined as describe in Example 1 herein.

| SEQ ID NO | Sequence | IC50 (nM) |
|---|---|---|
| 838 | Ac-WVTHRLAGL(Nva)S[Cit]SGGVC $^{(20\ kDa\ MeO\text{-}PEG)}$RNNFVPTDVGPFAF-amide | |
| 839 | Ac-WVTH[Cit]LAGLVS[Cit]SGGVCRNNFVPTDVGPFAF-amide | |
| 840 | Ac-WVTH[Cit]LAGLVS[Cit]SGGVC $^{(20\ kDa\ MeO\text{-}PEG)}$RNNFVPTDVGPFAF-amide | |
| 841 | Ac-WVTH[Cit]LAGL[Nva]S[Cit]SGGVCRNNFVPTDVGPFAF-amide | |
| 842 | Ac-WVTH[Cit]LAGL[Nva]S[Cit]SGGVC $^{(20\ kDa\ MeO\text{-}PEG)}$RNNFVPTDVGPFAF-amide | |
| 843 | Ac-WVTHQLAGLLSQSGGVCRNNFVPTDVGPFAF-amide | |
| 844 | Ac-WVTHQLAGLLSQSGGVC $^{(20\ kDa\ MeO\text{-}PEG)}$RNNFVPTDVGPFAF-amide | |
| 845 | Ac-WVTH[Cit]LAGLLS[Cit]SGGVCRNNFVPTDVGPFAF-amide | |
| 846 | Ac-WVTH[Cit]LAGLLS[Cit]SGGVC $^{(20\ kDa\ MeO\text{-}PEG)}$RNNFVPTDVGPFAF-amide | |
| 847 | Ac-WVTHRLAGLLS[Cit]SGG VCRKNFVPTDVGPFAF-amide | |
| 848 | Ac-WVTHRLAGLASRSGGVVRKNFVPTDVGPFAF-amide | |
| 849 | Ac-WVTHRLAGLASRSGGVVRK $^{(20\ kDa\ MeO\text{-}PEG)}$NFVPTDVGPFAF-amide | |
| 850 | Ac-WVTHRLAGLAS[Cit]SGGVVRKNFVPTDVGPFAF-amide | 1.85 |
| 851 | Ac-WVTHRLAGLAS[Cit]SGGVVRK $^{(20\ kDa\ MeO\text{-}PEG)}$NFVPTDVGPFAF-amide | 227.78 |
| 852 | Ac-WVTH[Cit]LAGLAS[Cit]SGGVVRKNFVPTDVGPFAF-amide | 23.37 |
| 853 | Ac-WVTH[Cit]LAGLAS[Cit]SGGVVRK $^{(20\ kDa\ MeO\text{-}PEG)}$NFVPTDVGPFAF-amide | >1000 |
| 854 | Ac-WVTHRLAGLLSR[P]GGVVRKNFVPTDVGPFAF-amide | 1.27 |
| 855 | Ac-WVTHRLAGLLSR]P]GGVVRK $^{(20\ kDa\ MeO\text{-}PEG)}$NFVPTDVGPFAF-amide | 17.96 |

Some embodiments of the inventive composition of matter also include a pharmaceutically acceptable vehicle conjugated to the CGRP peptide at a site on the CGRP peptide other than at its carboxy terminal residue.

"Vehicle-conjugated" means that the CGRP peptide and the vehicle are covalently attached or linked to each other, either directly attached, or indirectly attached via a linker moiety.

The term "vehicle" refers to a molecule that prevents or mitigates in vivo degradation, increases half-life, reduces toxicity, reduces immunogenicity, and/or increases biological activity of a therapeutic peptide. In accordance with the invention, the vehicle is a pharmaceutically acceptable vehicle. The vehicle should be selected such that the vehicle-conjugated CGRP peptide antagonist achieves a sufficient hydrodynamic size to prevent clearance by renal filtration in vivo. For example, a vehicle can be selected that is a polymeric macromolecule, which is substantially straight chain, branched-chain, or dendritic in form. Alternatively, a vehicle can be selected such that, in vivo, the inventive composition of matter will bind to a plasma protein to form a complex, such that the complex thus formed avoids substantial renal clearance.

Exemplary vehicles that can be used, in accordance with the present invention, include a polyalkylene glycol compound, such as a polyethylene glycol or a polypropylene glycol. Other appropriate polyalkylene glycol compounds include, but are not limited to, charged or neutral polymers of the following types: dextran, colominic acids or other carbohydrate based polymers, polymers of amino acids, and biotin derivatives.

Other examples of the vehicle, in accordance with the invention, include a copolymer of ethylene glycol, a copolymer of propylene glycol, a carboxymethylcellulose, a polyvinyl pyrrolidone, a poly-1,3-dioxolane, a poly-1,3,6-trioxane, an ethylene/maleic anhydride copolymer, a polyaminoacid (e.g., polylysine), a dextran n-vinyl pyrrolidone, a poly n-vinyl pyrrolidone, a propylene glycol homopolymer, a propylene oxide polymer, an ethylene oxide polymer, a polyoxyethylated polyol, a polyvinyl alcohol, a linear or branched glycosylated chain, a polyacetal, a long chain fatty acid, a long chain hydrophobic aliphatic group, an immunoglobulin F, domain (see, e.g., Feige et al., Modified peptides as therapeutic agents, U.S. Pat. No. 6,660,843), an albumin (e.g., human serum albumin; see, e.g., Rosen et al., Albumin fusion proteins, U.S. Pat. No. 6,926,898 and US 2005/0054051; Bridon et al., Protection of endogenous therapeutic peptides from peptidase activity through conjugation to blood components, U.S. Pat. No. 6,887,470), a transthyretin (TTR; see, e.g., Walker et al., Use of transthyretin peptide/protein fusions to increase the serum half-life of pharmacologically active peptides/proteins, US 2003/0195154 A1; 2003/0191056 A1), or a thyroxine-binding globulin (TBG).

Other embodiments of the vehicle, in accordance with the invention, include peptide ligands or small (organic) molecule ligands that have binding affinity for a long half-life plasma protein under physiological conditions of temperature, pH, and ionic strength. Examples include an albumin-binding peptide or small molecule ligand, a transthyretin-binding peptide or small molecule ligand, a thyroxine-binding globulin-binding peptide or small molecule ligand, an antibody-binding peptide or small molecule ligand, or another peptide or small molecule that has an affinity for a long half-life plasma protein. (See, e.g., Blaney et al., Method and compositions for increasing the serum half-life of pharmacologically active agents by binding to transthyretin-selective ligands, U.S. Pat. No. 5,714,142; Sato et al., Serum albumin binding moieties, US 2003/0069395 A1; Jones et al., Pharmaceutical active conjugates, U.S. Pat. No. 6,342,225). A "long half-life plasma protein" is one of the hundreds of different proteins dissolved in mammalian blood plasma, including so-called "carrier proteins" (such as albumin, transferrin and haptoglobin), fibrinogen and other blood coagulation factors, complement components, immunoglobulins, enzyme inhibitors, precursors of substances such as angiotensin and bradykinin and many other types of proteins. The invention encompasses the use of any single species of pharmaceutically acceptable vehicle, such as, but not limited to, those described herein, in conjugation with the $CGRP_1$ receptor-binding peptide, or the use of a combination of two or more different vehicles.

In accordance with the present invention, which also relates to a method of producing a composition of matter, the following steps are included: a CGRP peptide as described herein above is obtained; and the obtained peptide is conjugated to a pharmaceutically acceptable vehicle at a site on the peptide other than at the carboxy terminal amino acid residue.

In being conjugated, the vehicle, as described herein, is covalently bound directly to an amino acid residue of the CGRP peptide itself, or optionally, to a peptidyl or non-peptidyl linker (including but not limited to aromatic linkers) that is covalently bound to an amino acid residue of the CGRP peptide. Any "linker" group is optional. When present, its chemical structure is not critical, since it serves primarily as a spacer, which can be useful in optimizing pharmacological activity of some embodiments of the inventive composition. The linker is preferably made up of amino acids linked together by peptide bonds. The linker moiety, if present, can be independently the same or different from any other linker, or linkers, that may be present in the inventive composition.

As stated above, the linker, if present, can be peptidyl in nature (i.e., made up of amino acids linked together by peptide bonds) and made up in length, preferably, of from 1 up to about 40 amino acid residues, more preferably, of from 1 up to about 20 amino acid residues, and most preferably of from 1 to about 9 amino acid residues. Preferably, but not necessarily, the amino acid residues in the linker are from among the twenty canonical amino acids, more preferably, cysteine, glycine, alanine, proline, arginine, asparagine, glutamine, serine and/or lysine. Even more preferably, a peptidyl linker is made up of a majority of amino acids that are sterically unhindered, such as glycine and alanine linked by a peptide bond. It is also desirable that, if present, a peptidyl linker be selected that avoids rapid proteolytic turnover in circulation in vivo, and/or which includes one or more copies of a $CGRP_1$ binding region. Some of these amino acids may be glycosylated, as is well understood by those in the art. For example, a useful linker sequence constituting a sialylation site is $X_1X_2NX_4X_5G$ (SEQ ID NO:1104), wherein $X_1$, $X_2$, $X_4$ and $X_5$ are each independently any amino acid residue.

In other embodiments, the 1 to 40 amino acids are selected from glycine, alanine, proline, asparagine, glutamine, and lysine. Preferably, a linker is made up of a majority of amino acids that are sterically unhindered, such as glycine and alanine. Thus, preferred linkers include polyglycines, poly(Gly-Ala)s, and polyalanines. Some exemplary peptidyl linkers are poly(Gly)$_{1-8}$, particularly (Gly)$_3$, (Gly)$_4$ (SEQ ID NO:1105), (Gly)$_5$ (SEQ ID NO:56) and (Gly)$_7$ (SEQ ID NO:57), as well as, poly(Gly)$_4$Ser (SEQ ID NO:67), poly(Gly-Ala)$_{2-4}$ and poly(Ala)$_{1-8}$. Other specific examples of peptidyl linkers include (Gly)$_5$Lys (SEQ ID NO:58), and (Gly)$_5$LysArg (SEQ ID NO:59). Other specific examples of linkers are: Other examples of useful peptidyl linkers are:

| | |
|---|---|
| (Gly)₃Lys(Gly)₄; | (SEQ ID NO: 60) |
| (Gly)₃AsnGlySer(Gly)₂; | (SEQ ID NO: 61) |
| (Gly)₃Cys(Gly)₄; and | (SEQ ID NO: 62) |
| GlyProAsnGlyGly. | (SEQ ID NO: 63) |

To explain the above nomenclature, for example, (Gly)$_3$Lys(Gly)$_4$ means Gly-Gly-Gly-Lys-Gly-Gly-Gly-Gly (SEQ ID NO:60). Other combinations of Gly and Ala are also useful.

Other preferred linkers are those identified herein as "L5" (GGGGS; SEQ ID NO:1106), "L10" (GGGGSGGGGS; SEQ ID NO:1107), "L25" GGGGSGGGGS GGGGSGGGGSGGGGS; SEQ ID NO:1108) and any linkers used in the working examples hereinafter.

In some embodiments of the compositions of this invention, which comprise a peptide linker moiety (L), acidic residues, for example, glutamate or aspartate residues, are placed in the amino acid sequence of the linker moiety (L). Examples include the following peptide linker sequences:

| | |
|---|---|
| GGEGGG; | (SEQ ID NO: 1109) |
| GGEEEGGG; | (SEQ ID NO: 1110) |
| GEEEG; | (SEQ ID NO: 1111) |
| GEEE; | (SEQ ID NO: 1112) |
| GGDGGG; | (SEQ ID NO: 1113) |
| GGDDDGG; | (SEQ ID NO: 1114) |
| GDDDG; | (SEQ ID NO: 1115) |
| GDDD; | (SEQ ID NO: 1116) |
| GGGGSDDSDEGSDGEDGGGGS; | (SEQ ID NO: 1117) |
| WEWEW; | (SEQ ID NO: 1118) |
| FEFEF; | (SEQ ID NO: 1119) |
| EEEWWW; | (SEQ ID NO: 1120) |
| EEEFFF; | (SEQ ID NO: 1121) |
| WWEEEWW; or | (SEQ ID NO: 1122) |
| FFEEEFF. | (SEQ ID NO: 1123) |

In other embodiments, the linker constitutes a phosphorylation site, e.g., $X_1X_2YX_3X_4G$ (SEQ ID NO:1124), wherein $X_1$, $X_2$, $X_3$ and $X_4$ are each independently any amino acid residue; $X_1X_2SX_3X_4G$ (SEQ ID NO:1125), wherein $X_1$, $X_2$, $X_3$ and $X_4$ are each independently any amino acid residue; or $X_1X_2TX_3X_4G$ (SEQ ID NO:1126), wherein $X_1$, $X_2$, $X_3$ and $X_4$ are each independently any amino acid residue.

The linkers shown here are exemplary; peptidyl linkers within the scope of this invention may be much longer and may include other residues. A peptidyl linker can contain, e.g., a N-terminal cysteine, another thiol, or nucleophile for conjugation with a vehicle. In another embodiment, the linker contains an N-terminal cysteine or homocysteine residue, or other 2-amino-ethanethiol or 3-amino-propanethiol moiety for conjugation to maleimide, iodoacetaamide or thioester, functionalized vehicles. Another useful peptidyl linker is a large, flexible linker comprising a random Gly/Ser/Thr sequence, for example: GSGSATGGSGSTASSGSGSATH (SEQ ID NO:64) or HGSGSATGGSGSTASSGSGSAT (SEQ ID NO:66), that is estimated to be about the size of a 1 kDa PEG molecule. Alternatively, a useful peptidyl linker may be comprised of amino acid sequences known in the art to form rigid helical structures (e.g., Rigid linker: -AE-AAAKEAAAKEAAAKAGG-) (SEQ ID NO:65). Additionally, a peptidyl linker can also comprise a non-peptidyl segment such as a 6 carbon aliphatic molecule of the formula —$CH_2$—$CH_2$—$CH_2$—$CH_2$—$CH_2$—$CH_2$—. The peptidyl linkers can be altered to form derivatives as described herein.

Optionally, non-peptidyl linkers are also useful for conjugating the vehicle to the peptide portion of the vehicle-conjugated CGRP peptide antagonist. For example, alkyl linkers such as —NH—$(CH_2)_s$—C(O)—, wherein s=2-20 can be used. These alkyl linkers may further be substituted by any non-sterically hindering group such as lower alkyl (e.g., $C_1$-$C_6$) lower acyl, halogen (e.g., Cl, Br), CN, $NH_2$, phenyl, etc. Exemplary non-peptidyl linkers are PEG linkers (e.g., shown below):

wherein n is such that the linker has a molecular weight of about 100 to about 5000 kilodaltons (kDa), preferably about 100 to about 500 kDa.

In one embodiment, the non-peptidyl linker is aryl. The linkers may be altered to form derivatives in the same manner as described herein. In addition, PEG moieties may be attached to the N-terminal amine or selected side chain amines by either reductive alkylation using PEG aldehydes or acylation using hydroxysuccinimido or carbonate esters of PEG, or by thiol conjugation.

Non-peptide portions of the inventive composition of matter, such as non-peptidyl linkers or non-peptide vehicles can be synthesized by conventional organic chemistry reactions.

The above is merely illustrative and not an exhaustive treatment of the kinds of linkers that can optionally be employed in accordance with the present invention.

In one useful embodiment of the inventive composition of matter and/or the method of producing a vehicle-conjugated CGRP peptide antagonist, the peptide is conjugated to the vehicle via covalent linkage at an amino acid residue in the hinge region, such as, at one of the nine amino acid residues at positions 19-27, relative to the native human αCGRP sequence. In some useful embodiments, the peptide is conjugated to the vehicle, more particularly, at amino acid position 22, position 23, position 24, position 25, position 26, or position 27, and preferably, at amino acid position 23, position 24, or position 25, relative to the native human αCGRP sequence.

In other embodiments of the inventive composition of matter and/or the method of producing a composition of matter, the CGRP peptide is conjugated to the vehicle at an amino acid residue in the first or the second $CGRP_1$ receptor binding region.

In still another useful embodiment of the inventive composition of matter and/or the method of producing a composition of matter, involving an inventive vehicle-conjugated CGRP peptide antagonist, the CGRP peptide is conjugated at the amino acid residue at the peptide's amino terminal end to the vehicle. (See, e.g., Kinstler et al., N-terminally chemically modified protein compositions and methods, U.S. Pat. Nos. 5,985,265, and 5,824,784).

It will be appreciated that, since the vehicle employed for conjugation to the CGRP peptide can be multivalent (e.g., bivalent, trivalent, tetravalent or a higher order valency), as to the number of residues at which vehicle can be conjugated, and/or the peptide portion of the inventive composition of matter can be multivalent (e.g., bivalent, trivalent, tetravalent or a higher order valency), it is possible by the inventive method of producing a composition of matter to produce a variety of conjugated vehicle:peptide structures. By way of example, a univalent vehicle and a univalent peptide will produce a 1:1 conjugate; a bivalent peptide and a univalent vehicle may form conjugates wherein the peptide conjugates bear two vehicle moieties, whereas a bivalent vehicle and a univalent peptide may produce species where two peptide entities are linked to a single vehicle moiety; use of higher-valence vehicles can lead to the formation of clusters of peptide entities bound to a single vehicle moiety, whereas higher-valence peptides may become encrusted with a plurality of vehicle moieties. By way of further example, if the site of conjugation of a multivalent vehicle to the CGRP peptide is a cysteine or other aminothiol the methods disclosed by D'Amico et al. may be employed (U.S. Ser. No. 60/646,685, Method of conjugating aminothiol containing molecules to water-soluble polymers, which application is incorporated herein by reference in its entirety).

The peptide moieties may have more than one reactive group which will react with the activated vehicle and the possibility of forming complex structures must always be considered; when it is desired to form simple structures such as 1:1 adducts of vehicle and peptide, or to use bivalent vehicles to form peptide:vehicle:peptide adducts, it will be beneficial to use predetermined ratios of activated vehicle and peptide material, predetermined concentrations thereof and to conduct the reaction under predetermined conditions (such as duration, temperature, pH, etc.) so as to form a proportion of the described product and then to separate the described product from the other reaction products. The reaction conditions, proportions and concentrations of the reagents can be obtained by relatively simple trial-and-error experiments which are within the ability of an ordinarily skilled artisan with appropriate scaling-up as necessary. Purification and separation of the products is similarly achieved by conventional techniques well known to those skilled in the art.

Additionally, physiologically acceptable salts of the vehicle-conjugated or unconjugated CGRP peptide antagonists of this invention are also encompassed within the present invention. By "physiologically acceptable salts" is meant any salts that are known or later discovered to be pharmaceutically acceptable. Some specific examples are: acetate; trifluoroacetate; hydrohalides, such as hydrochloride and hydrobromide; sulfate; citrate; maleate; tartrate; glycolate; gluconate; succinate; mesylate; besylate; and oxalate salts.

As an illustration, in some embodiments of the inventive composition of matter and/or the method of producing a composition of matter, the vehicle is poly(ethylene glycol) (PEG). Covalent conjugation of proteins with poly(ethylene glycol) (PEG) has been widely recognized as an approach to significantly extend the in vivo circulating half-lives of therapeutic proteins. PEGylation achieves this effect predominately by retarding renal clearance, since the PEG moiety adds considerable hydrodynamic radius to the protein. (Zalipsky, S., et al., Use of functionalized poly(ethylene glycol)s for modification of polypeptides., in poly(ethylene glycol) chemistry: Biotechnical and biomedical applications., J. M. Harris, Ed., Plenum Press: New York., 347-370 (1992)). Additional benefits often conferred by PEGylation of proteins include increased solubility, resistance to proteolytic degradation, and reduced immunogenicity of the therapeutic polypeptide. The merits of protein PEGylation are evidenced by the commercialization of several PEGylated proteins including PEG-Adenosine deaminase (Adagen™/Enzon Corp.), PEG-L-asparaginase (Oncaspar™/Enzon Corp.), PEG-Interferon α-2b (PEG-Intron™/Schering/Enzon), PEG-Interferon α-2a (PEGASYS™/Roche) and PEG-G-CSF (Neulasta™/Amgen) as well as many others in clinical trials.

By "PEGylated peptide" is meant a peptide having a polyethylene glycol (PEG) moiety covalently bound to an amino acid residue of the peptide itself or to a peptidyl or non-peptidyl linker (including but not limited to aromatic linkers) that is covalently bound to a residue of the peptide.

By "polyethylene glycol" or "PEG" is meant a polyalkylene glycol compound or a derivative thereof, with or without coupling agents or derivatization with coupling or activating moieties (e.g., with aldehyde, hydroxysuccinimidyl, hydrazide, thiol, triflate, tresylate, azirdine, oxirane, orthopyridyl disulphide, vinylsulfone, iodoacetamide or a maleimide moiety). In accordance with the present invention, useful PEG includes substantially linear, straight chain PEG, branched PEG, or dendritic PEG. (See, e.g., Merrill, U.S. Pat. No. 5,171,264; Harris et al., Multiarmed, monofunctional, polymer for coupling to molecules and surfaces, U.S. Pat. No. 5,932,462; Shen, N-maleimidyl polymer derivatives, U.S. Pat. No. 6,602,498).

PEG is a well-known, water soluble polymer that is commercially available or can be prepared by ring-opening polymerization of ethylene glycol according to methods well known in the art (Sandler and Karo, Polymer Synthesis, Academic Press, New York, Vol. 3, pages 138-161). In the present application, the term "PEG" is used broadly to encompass any polyethylene glycol molecule, in mono-, bi-, or poly-functional form, without regard to size or to modification at an end of the PEG, and can be represented by the formula:

$$X\text{—}O(CH_2CH_2O)_{n-1}CH_2CH_2OH, \quad (II)$$

where n is 20 to 2300 and X is H or a terminal modification, e.g., a $C_{1-4}$ alkyl.

In some useful embodiments, a PEG used in the invention terminates on one end with hydroxy or methoxy, i.e., X is H or $CH_3$ ("methoxy PEG"). It is noted that the other end of the PEG, which is shown in formula (II) terminating in OH, covalently attaches to an activating moiety via an ether oxygen bond, an amine linkage, or amide linkage. When used in a chemical structure, the term "PEG" includes the formula (II) above without the hydrogen of the hydroxyl group shown, leaving the oxygen available to react with a free carbon atom of a linker to form an ether bond. More specifically, in order to conjugate PEG to a peptide, the peptide must be reacted with PEG in an "activated" form. Activated PEG can be represented by the formula:

$$(PEG)\text{-}(A) \quad (III)$$

where PEG (defined supra) covalently attaches to a carbon atom of the activation moiety (A) to form an ether bond, an amine linkage, or amide linkage, and (A) contains a reactive group which can react with an amino, imino, or thiol group on an amino acid residue of a peptide or a linker moiety covalently attached to the peptide.

Techniques for the preparation of activated PEG and its conjugation to biologically active peptides are well known in the art. (E.g., see U.S. Pat. Nos. 5,643,575, 5,919,455, 5,932, 462, and 5,990,237; Thompson et al., PEGylation of polypeptides, EP 0575545 B1; Petit, Site specific protein modification, U.S. Pat. Nos. 6,451,986, and 6,548,644; S. Herman et al., Poly(ethylene glycol) with reactive endgroups: 1. Modification of proteins, J. Bioactive Compatible Polymers, 10:145-187 (1995); Y. Lu et al., Pegylated peptides III: Solid-phase synthesis with PEGylating reagents of varying molecular weight: synthesis of multiply PEGylated peptides, Reactive Polymers, 22:221-229 (1994); A. M. Felix et al., PEGylated Peptides IV: Enhanced biological activity of site-directed PEGylated GRF analogs, Int. J. Peptide Protein Res., 46:253-264 (1995); A. M. Felix, Site-specific poly(ethylene glycol)ylation of peptides, ACS Symposium Series 680(poly (ethylene glycol)): 218-238 (1997); Y. Ikeda et al., Polyethylene glycol derivatives, their modified peptides, methods for producing them and use of the modified peptides, EP 0473084 B1; G. E. Means et al., Selected techniques for the modification of protein side chains, in: Chemical modification of proteins, Holden Day, Inc., 219 (1971)).

Activated PEG, such as PEG-aldehydes or PEG-aldehyde hydrates, can be chemically synthesized by known means or obtained from commercial sources, e.g., Shearwater Polymers, (Huntsville, Ala.) or Enzon, Inc. (Piscataway, N.J.).

An example of a useful activated PEG for purposes of the present invention is a PEG-aldehyde compound (e.g., a methoxy PEG-aldehyde), such as PEG-propionaldehyde, which is commercially available from Shearwater Polymers (Huntsville, Ala.). PEG-propionaldehyde is represented by the formula PEG-$CH_2CH_2CHO$. (See, e.g., U.S. Pat. No. 5,252, 714). Also included within the meaning of "PEG aldehyde compound" are PEG aldehyde hydrates, e.g., PEG acetaldehyde hydrate and PEG bis aldehyde hydrate, which latter yields a bifunctionally activated structure. (See., e.g., Bentley et al., Poly(ethylene glycol) aldehyde hydrates and related polymers and applications in modifying amines, U.S. Pat. No. 5,990,237) (See., e.g., Bentley et al., Poly(ethylene glycol) aldehyde hydrates and related polymers and applications in modifying amines, U.S. Pat. No. 5,990,237). An activated multi-branched PEG-aldehyde compound can be used (PEG derivatives comprising multiple arms to give divalent, trivalent, tetravalent, octavalent constructs). Using a 4-arm PEG derivative four (4) CGRP peptides are attached to each PEG molecule. For example, in accordance with the present invention, the CGRP peptide can be conjugated to a polyethylene glycol (PEG) at 1, 2, 3 or 4 amino functionalized sites of the PEG.

In being conjugated in accordance with the inventive method, the polyethylene glycol (PEG), as described herein, is covalently bound by reductive amination directly to at least one solvent-exposed free amine moiety of an amino acid residue of the CGRP peptide itself. In some embodiments of the inventive method, the CGRP peptide is conjugated to a PEG at one or more primary or secondary amines on the CGRP peptide, or to two PEG groups at a single primary amine site on the CGRP peptide (e.g., this can occur when the reductive amination reaction involves the presence of excess PEG-aldehyde compound). We have observed that when PEGylation by reductive amination is at a primary amine on the peptide, it is not uncommon to have amounts (1 to 100% range) of reaction product that have two or more PEGs present per molecule, and if the desired PEGylation product is one with only one PEG per molecule, then this "over-PEGylation" may be undesirable. When PEGylated product with a single PEG per PEGylation product molecule is desired, an embodiment of the inventive method can be employed that involves PEGylation using secondary amines of the pharmacologically active peptide, because only one PEG group per molecule will be transferred in the reductive amination reaction.

Amino acid residues that can provide a primary amine moiety include residues of lysine, homolysine, ornithine, α,β-diaminopropionic acid (Dap), α,β-diaminopropionoic acid (Dpr), and α,γ-diaminobutyric acid (Dab), aminobutyric acid (Abu), and α-amino-isobutyric acid (Aib). Amino acid residues that can provide a secondary amine moiety include ε-N-alkyl lysine, α-N-alkyl lysine, δ-N-alkyl ornithine, α-N-alkyl ornithine, or an N-terminal proline, where the alkyl is $C_1$ to $C_6$.

In accordance with the inventive method of producing a composition of matter, the inclusion of an alcohol co-solvent in a buffer solution can improve the conjugation efficiency of CGRP peptides to PEG aldehyde compounds by reductive amination, as is further illustrated in Example 8 herein below. The buffer solution for the PEGylation reaction comprises an "alcohol co-solvent", which term encompasses an alcohol solvent, in embodiments in which the (v/v) concentration of the alcohol is 100% as described below. However, in many embodiments, the concentration (v/v) of the alcohol co-solvent in an aqueous medium is about 30% to about 99%, or about 30% to about 90%, or about 30% to about 80%, or about 30% to about 70%, with about 50% to about 70% being a preferred concentration range. The skilled artisan will understand how to optimize the alcohol concentration for reductive amination of a particular species of CGRP peptide with a particular species of PEG-aldehyde compound. By way of example, for some small CGRP peptides (e.g., about 10-20 amino acid residues in length), an alcohol (e.g., TFE) concentration of 100% (v/v) is suitable.

Useful aqueous buffer solutions for the reductive amination reaction can be made with any of the buffers known in the biochemical art that provide buffering from about pH 4 to about pH 9, with about pH 5 to about pH 7 preferred. These buffers can include, but are not limited to, acetate, citrate, 2-(N-Morpholino)-ethane sulfonic acid (MES), phosphate, N,N-Bis(2hydroxyethyl)glycine (Bicine), or borate buffers. Useful buffer concentrations may range from 5 mM to 100 mM with 10-50 mM preferred. Buffers containing a free amine group, such as TRIS, are not suitable.

Alcohols that should accelerate the reductive amination of PEG aldehydes with amine containing peptides include 2,2,2-trifluoroethanol (TFE), 1,1,1,3,3,3-hexafluoro-2-propanol (HF-i-PA), and 2-trifluoromethyl-1,1,1,3,3,3-hexafluoro-2-propanol (HF-t-BuOH), although, in principle, any alcohol co-solvent based on structural Formulae IV, V and VI (below) could increase the PEGylation efficiency during reductive amination. The alcohol co-solvent comprises a structure selected from structural Formulae IV, V and VI:

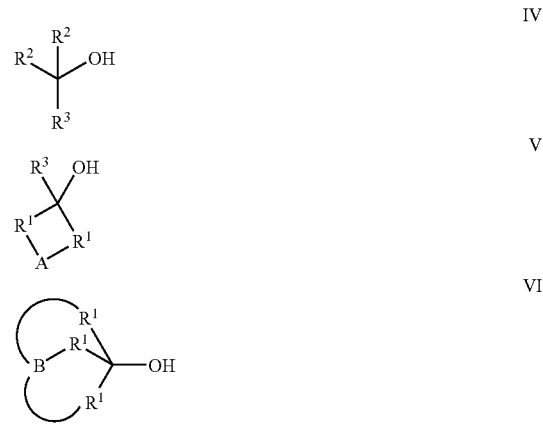

wherein $R^1$ is independently $CF_nR^4_{2-n}$, n=1 to 3; wherein Formula VI comprises at least seven carbon atoms;
$R^4$ is a ($C_1$ to $C_4$) linear or branched alkyl moiety, a ($C_3$ to $C_6$) cyclic alkyl moiety, or an aryl or heteroaryl moiety;
$R^2$ and $R^3$ are independently H or $R^1H$;
A is $(CY_2)o$, wherein o equals 1 to 4, or $(CY_2—X—CY_2)$, wherein X is O or $NR^5$ and Y is independently H or F;
$R^5$ is independently H or a ($C_1$ to $C_4$) linear or branched alkyl; and wherein B is $C(R^5)$ or N.
(B is capable of forming a stable bicyclic structure such as bicyclo[2.2.2]octane, or the like.) In some embodiments, if X is O, Y is independently H or F; and if X is $NR^5$, Y is H.

In general, the PEGylation efficiency of CGRP peptide sequences benefits from more hydrophobic alcohols such as 1HF-i-PA or HP-t-BuOH. While this aspect of the present invention does not depend upon any particular mechanism of operation, it is thought that this observation relates to the increased solubility of aliphatic side chain residues in aliphatic solvents. In this context, the rank-order of aliphatic character is HP-t-BuOH>HF-i-PA>TFE. The efficiency enhancement afforded by β-fluoro alcohols would be most advantageous to reductive amination reactions. This is hypothetically related to the strong hydrogen bonding character associated with β-fluoro alcohols such as TFE for two reasons. The first of which is the ability to dissolve polyamide structure by solvating the amide oxygen. Secondly, the strong H-bonding ability afforded by the β-fluoro alcohol should facilitate imine formation between PEG aldehyde and an amine present on the peptide in the same manner that acid does. Imine formation is a required step in the reductive amination process, and is often rate-limiting. The ability of β-fluoro alcohol to accelerate this step is therefore of particular advantage.

Another useful activated PEG for generating the PEG-conjugated peptides of the present invention is a PEG-maleimide compound, such as, but not limited to, a methoxy PEG-maleimide, such as maleimido monomethoxy PEG, are particularly useful for generating the PEG-conjugated peptides of the invention. (E.g., Shen, N-maleimidyl polymer derivatives, U.S. Pat. No. 6,602,498; C. Delgado et al., The uses and properties of PEG-linked proteins., Crit. Rev. Therap. Drug Carrier Systems, 9:249-304 (1992); S. Zalipsky et al., Use of functionalized poly(ethylene glycol)s for modification of polypeptides, in: Poly(ethylene glycol) chemistry: Biotechnical and biomedical applications (J. M. Harris, Editor, Plenum Press: New York, 347-370 (1992); S. Herman et al., Poly(ethylene glycol) with reactive endgroups: 1. Modification of proteins, J. Bioactive Compatible Polymers, 10:145-187 (1995); P. J. Shadle et al., Conjugation of polymer to colony stimulating factor-1, U.S. Pat. No. 4,847,325; G. Shaw et al., Cysteine added variants IL-3 and chemical modifications thereof, U.S. Pat. No. 5,166,322 and EP 0469074 B1; G. Shaw et al., Cysteine added variants of EPO and chemical modifications thereof, EP 0668353 A1; G. Shaw et al., Cysteine added variants G-CSF and chemical modifications thereof, EP 0668354 A1; N. V. Katre et al., Interleukin-2 muteins and polymer conjugation thereof, U.S. Pat. No. 5,206,344; R. J. Goodson and N. V. Katre, Site-directed pegylation of recombinant interleukin-2 at its glycosylation site, Biotechnology, 8:343-346 (1990)).

A poly(ethylene glycol) vinyl sulfone is another useful activated PEG for generating the PEG-conjugated peptides of the present invention by conjugation at thiolated amino acid residues, e.g., at C residues. (E.g., M. Morpurgo et al., Preparation and characterization of poly(ethylene glycol) vinyl sulfone, Bioconj. Chem., 7:363-368 (1996); see also Harris, Functionalization of polyethylene glycol for formation of active sulfone-terminated PEG derivatives for binding to proteins and biologically compatible materials, U.S. Pat. Nos. 5,446,090; 5,739,208; 5,900,461; 6,610,281 and 6,894,025; and Harris, Water soluble active sulfones of poly(ethylene glycol), WO 95/13312 A1).

Another activated form of PEG that is useful in accordance with the present invention, is a PEG-N-hydroxysuccinimide ester compound, for example, methoxy PEG-N-hydroxysuccinimidyl (NHS) ester.

Heterobifunctionally activated forms of PEG are also useful. (See, e.g., Thompson et al., PEGylation reagents and biologically active compounds formed therewith, U.S. Pat. No. 6,552,170).

In still other embodiments of the inventive method of producing a composition of matter, the CGRP peptide is reacted by known chemical techniques with an activated PEG compound, such as but not limited to, a thiol-activated PEG compound, a diol-activated PEG compound, a PEG-hydrazide compound, a PEG-oxyamine compound, or a PEG-bromoacetyl compound. (See, e.g., S. Herman, Poly(ethylene glycol) with Reactive Endgroups: 1. Modification of Proteins, J. Bioactive and Compatible Polymers, 10: 145-187 (1995); S. Zalipsky, Chemistry of Polyethylene Glycol Conjugates with Biologically Active Molecules, Advanced Drug Delivery Reviews, 16:157-182 (1995); R. Greenwald et al., Poly(ethylene glycol) conjugated drugs and prodrugs: a comprehensive review, Critical Reviews in Therapeutic Drug Carrier Systems, 17:101-161 (2000)).

Any molecular mass for a PEG can be used as practically desired, e.g., from about 1,000 Daltons (Da) to 100,000 Da (n is 20 to 2300). The number of repeating units "n" in the PEG is approximated for the molecular mass described in Daltons. It is preferred that the combined molecular mass of PEG on an activated linker is suitable for pharmaceutical use. Thus, the combined molecular mass of the PEG molecule should not exceed about 100,000 Da.

In still other embodiments of the inventive method of producing a composition of matter, the CGRP peptide is reacted by known chemical techniques with an activated multi-branched PEG compound (PEG derivatives comprising multiple arms to give divalent, trivalent, tetravalent, octavalent constructs), such as but not limited to, pentaerythritol tetra-polyethyleneglycol ether. Functionalization and activated derivatives, such as, but not limited to, N-succinimidyloxycarbonyl)propyl, p-nitrophenyloxycarbonyl, (—CO$_2$-p-C$_6$H$_4$NO$_2$), 3-(N-maleimido)propanamido, 2-sulfanylethyl, and 3-aminopropyl. Using a 4-arm PEG derivative four CGRP peptide antagonists are attached to each PEG molecule. For example, in accordance with the present invention, the CGRP peptide can be conjugated to a polyethylene glycol (PEG) at:

(a) 1, 2, 3 or 4 amino functionalized sites of the PEG;
(b) 1, 2, 3 or 4 thiol functionalized sites of the PEG;
(c) 1, 2, 3 or 4 maleimido functionalized sites of the PEG;
(d) 1, 2, 3 or 4 N-succinimidyl functionalized sites of the PEG;
(e) 1, 2, 3 or 4 carboxyl functionalized sites of the PEG; or
(f) 1, 2, 3 or 4 p-nitrophenyloxycarbonyl functionalized sites of the PEG.

Preferably, the combined or total molecular mass of PEG used in a PEG-conjugated peptide of the present invention is from about 3,000 Da to 60,000 Da (total n is from 70 to 1,400), more preferably from about 10,000 Da to 40,000 Da (total n is about 230 to about 910). The most preferred combined mass for PEG is from about 20,000 Da to 30,000 Da (total n is about 450 to about 680).

The present invention also provides methods of using the inventive composition of matter and the pharmaceutical compositions containing them, e.g., in the inventive methods of treating migraine, and preventing or mitigating migraine. The inventive methods are of benefit in alleviating and/or mitigating symptoms of migraine. "Alleviated" means to be lessened, lightened, diminished, softened, mitigated (i.e., made more mild or gentle), quieted, assuaged, abated, relieved, nullified, or allayed, regardless of whether the pain or migraine symptom is entirely erased, eradicated, eliminated, or prevented in a particular patient.

If desired, the therapeutic or prophylactic efficacy of the CGRP peptide antagonists may be tested preclinically, prior to clinical use in humans, using any appropriate animal model known to those skilled in the art related to a particular condition of interest. (See, e.g., Wang and Wang, Animal and cellular models of chronic pain, Advanced Drug Delivery Reviews 55:949-965 (2003)). An appropriate animal model for migraine can be selected from numerous methods, as described, for example, in Bergerot et al., Review Article: Animal models of migraine: looking at the component parts of a complex disorder, European Journal of Neuroscience 24:1517-1534 (2006); and Akerman, S and Goadsby P J, The role of dopamine in a model of trigeminovascular nociception, Pharmacol. Exp. Ther. 314(1): 162-169 (2005), which are both incorporated by reference in there entireties.

The present invention is directed to a method of treating migraine, and to a method of preventing or mitigating migraine. The method of treating migraine includes administering to a patient in need of such treatment a therapeutically effective amount of the inventive composition of matter, such that one or more migraine symptoms is alleviated in the patient. The inventive method of preventing or mitigating migraine includes administering to a patient who has previously experienced a migraine a prophylactically effective amount of the inventive composition of matter such that at least one symptom of a subsequent migraine is prevented or mitigated. The at least one symptom is a migraine symptom previously experienced by the patient migraineur in a prior migraine attack.

In accordance with these inventive methods, a patient in need of treatment for migraine, or a patient who has previously experienced a migraine, are well-recognizable and/or diagnosed by the skilled practitioner, such as a physician, familiar with migraine and its symptoms.

There are several types of migraine, each with unique features or symptoms well known to those of skill in the art, but the present invention is not limited to any one type and can be useful in treating, alleviating, preventing or mitigating symptoms of any type of migraine. Classic migraine and common migraine are the two major varieties. Common migraine (without aura) is the most frequent type, accounting for about 80-85% of migraines. Unlike other headaches, migraines usually occur on one side of the head, although the side that is affected can shift with each new attack. Migraines are also often accompanied by symptoms of abnormal sensitivity to light and/or sound. The pain symptoms of a migraine headache are often described as an intense throbbing or pounding felt in the forehead/temple, ear/jaw or around the eyes. Although migraine pain usually appears on one side of the head, 30-40% of migraines occur on both sides. A migraine attack typically lasts about 4 to 72 hours. Migraine symptoms may also include speech difficulty, nausea, vomiting, confusion, weakness of an arm or leg and tingling of face or hands.

The basic difference between common and classic types of migraine is the appearance of an "aura." The aura is the occurrence of neurological symptoms 10-30 minutes before the classic migraine attack. During migraine aura, the migraineur may see flashing or shimmering lights, zigzag lines, geometric shapes, or may temporarily lose vision (e.g., hemianopsia), or experience blind spots called scotomas, experience speech disturbances, or experience other sensory phenomena, such as gustatory and/or olfactory hallucinations. Other symptoms of migraine aura may include numbness, tingling, speech difficulties and muscle weakness on one side of the body.

Another type of migraine is basilar migraine, which is accompanied by transient brainstem signs thought to be due to vasospastic narrowing of the basilar artery. In basilar-type migraine, the migraine sufferer meets the general criteria for migraine with aura and has two or more of the following symptoms: dysarthria, vertigo, tinnitus, hypacusia, double vision (diplopia), bilateral visual symptoms, ataxia, perioral numbness, decreased level of consciousness, and/or simultaneously bilateral paraesthesias.

The above-described symptoms of migraine are merely illustrative and are not intended to be an exhaustive description of all possible migraine symptoms experienced by a single patient or by several migraine sufferers in composite, and to which the present invention is directed. Those skilled in the art are aware of various other migraine symptoms and constellations of migraine symptoms suffered by individual patients, and to those migraine symptoms are also directed the present inventive methods of treating migraine, or preventing or mitigating migraine.

The therapeutically effective amount, prophylactically effective amount, and dosage regimen involved in the inventive methods of treating chronic pain or migraine, or of preventing or mitigating migraine, will be determined by the attending physician, considering various factors which modify the action of therapeutic agents, such as the age, condition, body weight, sex and diet of the patient, the severity of the condition being treated, time of administration, and other clinical factors. Generally, the daily amount or regimen should be in the range of about 1 to about 10,000 micrograms (μg) of the CGRP peptide per kilogram (kg) of body mass, preferably about 1 to about 5000 μg per kilogram of body mass, and most preferably about 1 to about 1000 μg per kilogram of body mass.

Accordingly, the present invention also relates to the use of one or more of the inventive compositions of matter in the manufacture of a medicament for the treatment or prevention of migraine.

Such pharmaceutical compositions can be configured for administration to a patient by a wide variety of delivery routes, e.g., an intravascular delivery route such as by injection or infusion, subcutaneous, intramuscular, intraperitoneal, epidural, or intrathecal delivery routes, or for oral, enteral, pulmonary (e.g., inhalant), intranasal, transmucosal (e.g., sublingual administration), transdermal or other delivery routes and/or forms of administration known in the art. The inventive pharmaceutical compositions may be prepared in liquid form, or may be in dried powder form, such as lyophilized form. For oral or enteral use, the pharmaceutical compositions can be configured, for example, as tablets, troches, lozenges, aqueous or oily suspensions, dispersible powders or granules, emulsions, hard or soft capsules, syrups, elixirs or enteral formulas.

In general, the invention encompasses pharmaceutical compositions comprising therapeutically effective amounts of the vehicle-conjugated or unconjugated CGRP peptide antagonist of the invention (in amounts effective to prevent, alleviate, mitigate, ameliorate, or abolish chronic pain, e.g., migraine, or any of the other medical causes, disorders, or conditions provided herein) together with one or more pharmaceutically acceptable carrier(s). In the practice of this invention the "pharmaceutically acceptable carrier" is any physiologically tolerated substance known to those of ordinary skill in the art useful in formulating pharmaceutical compositions, including, any pharmaceutically acceptable diluents, excipients, dispersants, binders, fillers, glidants, anti-frictional agents, compression aids, tablet-disintegrating agents (disintegrants), suspending agents, lubricants, flavorants, odorants, sweeteners, permeation or penetration enhancers, preservatives, surfactants, solubilizers, emulsifiers, thickeners, adjuvants, dyes, coatings, encapsulating material(s), and/or other additives singly or in combination.

For example, binders can be used to hold the components of the pharmaceutical composition together to form a hard tablet, and they include materials from natural products such as acacia, tragacanth, starch and gelatin. Others include methyl cellulose (MC), ethyl cellulose (EC) and carboxymethyl cellulose (CMC). Polyvinyl pyrrolidone (PVP) and hydroxypropylmethyl cellulose (HPMC) could both be used in alcoholic solutions to granulate the therapeutic.

Disintegrants can be included in the formulation of the pharmaceutical composition into a solid dosage form. Materials used as disintegrants include, but are not limited to, starch, including the commercially available disintegrant based on starch, Explotab. Sodium starch glycolate, Amberlite, sodium carboxymethylcellulose, ultramylopectin, sodium alginate, gelatin, orange peel, acid carboxymethyl cellulose, natural sponge and bentonite can also be used. Another useful form of the disintegrants are the insoluble cationic exchange resins. Powdered gums may be used as disintegrants and as binders, and these can include powdered gums such as agar, Karaya or tragacanth. Alginic acid and its sodium salt are also useful as disintegrants.

An anti-frictional agent can be included in the formulation of some embodiments of the pharmaceutical composition to prevent sticking during the formulating process.

Lubricants can be used as a layer between the pharmaceutical composition and the die wall in preparation of a molded formulation (e.g., a tablet or caplet), and these can include, but are not limited to: stearic acid, including its magnesium and calcium salts, polytetrafluoroethylene (PTFE), liquid paraffin, vegetable oils and waxes. Soluble lubricants can also be used, such as sodium lauryl sulfate, magnesium lauryl sulfate, polyethylene glycol of various molecular weights, Carbowax 4000 and 6000.

Glidants can be included to improve the flow properties of the vehicle-conjugated or unconjugated CGRP peptide antagonists and/or pharmaceutical compositions during formulation and to aid rearrangement during compression. Useful glidants include starch, talc, pyrogenic silica and hydrated silicoaluminate.

To aid dissolution of the compositions of matter and/or pharmaceutical compositions of the present invention into an aqueous environment, a surfactant can be included as a wetting agent. Surfactants may include anionic detergents such as sodium lauryl sulfate, dioctyl sodium sulfosuccinate and dioctyl sodium sulfonate. Cationic detergents might be used and could include benzalkonium chloride or benzethonium chloride. The list of potential nonionic detergents that could be included in the formulation as surfactants are lauromacrogol 400, polyoxyl 40 stearate, polyoxyethylene hydrogenated castor oil 10, 50 and/or 60, glycerol monostearate, polysorbate 40, 60, 65 and/or 80, sucrose fatty acid ester, methyl cellulose and/or carboxymethyl cellulose. These surfactants can be present in the formulation of the vehicle-conjugated or unconjugated CGRP peptide antagonist-containing pharmaceutical compositions, either individually or as a mixture of surfactants in different ratios.

Some other additives can also be included in the formulation of the pharmaceutical composition to enhance uptake of the vehicle-conjugated or unconjugated CGRP peptide antagonists. Additives potentially having this property are for instance the fatty acids oleic acid, linoleic acid and linolenic acid.

In one embodiment the pharmaceutically acceptable carrier can be a liquid and the pharmaceutical composition is prepared in the form of a solution, suspension, emulsion, syrup, elixir or pressurized composition. The active ingredient(s) (e.g., the inventive composition of matter) can be dissolved, diluted or suspended in a pharmaceutically acceptable liquid carrier such as water, an organic solvent, a mixture of both, or pharmaceutically acceptable oils or fats. The liquid carrier can contain other suitable pharmaceutical additives such as detergents and/or solubilizers (e.g., Tween 80, Polysorbate 80), emulsifiers, buffers at appropriate pH (e.g., Tris-HCl, acetate, phosphate), adjuvants, anti-oxidants (e.g., ascorbic acid, sodium metabisulfite), preservatives (e.g., Thimersol, benzyl alcohol), sweeteners, flavoring agents, suspending agents, thickening agents, bulking substances (e.g., lactose, mannitol), colors, viscosity regulators, stabilizers, electrolytes, osmolutes or osmo-regulators.

Suitable examples of liquid pharmaceutically acceptable carriers for oral and enteral administration of the pharmaceutical composition include water (partially containing additives as above, e.g. cellulose derivatives, preferably sodium carboxymethyl cellulose solution), alcohols (including monohydric alcohols and polyhydric alcohols, e.g. glycols) and their derivatives, and oils (e.g. fractionated coconut oil and arachis oil). The inventive pharmaceutical compositions can be administered to a patient orally or enterally in the form of a sterile solution or suspension containing other solutes or suspending agents (for example, enough saline or glucose to make the solution isotonic), bile salts, acacia, gelatin, sorbitan monoleate, polysorbate 80 (oleate esters of sorbitol and its anhydrides copolymerized with ethylene oxide) and the like. For enteral administration, the carrier can also include an oily ester such as ethyl oleate and isopropyl myristate.

The pharmaceutically acceptable carrier for pressurized compositions, such as a composition configured as an inhalant, can be a halogenated hydrocarbon or other pharmaceutically acceptable aerosol propellant. (See, e.g., Bäckström et al., Aerosol drug formulations containing hydrofluoroalkanes and alkyl saccharides, U.S. Pat. No. 6,932,962).

In another embodiment, the pharmaceutically acceptable carrier is a solid and the pharmaceutical composition is in the form of a powder, granules, microparticles, microspheres, or tablet. The vehicle-conjugated or unconjugated CGRP peptide antagonists can be incorporated into particulate or microparticle preparations of polymeric compounds such as polylactic acid, polyglycolic acid, etc. or into liposomes. Hyaluronic acid may also be used, and this may have the effect of promoting sustained duration in the circulation. Such compositions may influence the physical state, stability, rate of in vivo release, and rate of in vivo clearance of the CGRP peptide antagonists. (See, e.g., Remington's Pharmaceutical Sciences, 18th Edition, Mack Publishing Co., Easton, Pa., 1435-1712 (1990), which is herein incorporated by reference in its entirety.) A solid carrier can also include one or more substances that can act as flavoring agents, lubricants, solubilizers, or suspending agents.

Colorants, odorants, and/or flavoring agents (flavorants) can also be included as carriers in the pharmaceutical composition formulated (such as by liposome or microsphere encapsulation) to be further contained within an edible product, such as a refrigerated beverage containing colorants, odorants and/or flavoring agents.

In powder forms, the pharmaceutically acceptable carrier is a finely divided solid, which is in admixture with finely divided active ingredient(s), including the inventive vehicle-conjugated or unconjugated CGRP peptide antagonist. For example, in some embodiments, a powder form is useful when the pharmaceutical composition is configured as an inhalant. (See, e.g., Zeng et al., Method of preparing dry powder inhalation compositions, WO 2004/017918; Trunk et al., Salts of the CGRP antagonist BIBN4096 and inhalable powdered medicaments containing them, U.S. Pat. No. 6,900,317).

In tablet form, the active ingredient(s) are mixed with a pharmaceutically acceptable carrier having the necessary compression properties in suitable proportions and compacted in the shape and size desired.

The powders and tablets preferably contain up to 99% of the active ingredient(s). Suitable solid carriers include, for example, calcium phosphate, magnesium stearate, talc, sugars, lactose, dextrin, starch, gelatin, cellulose, polyvinylpyrrolidine, low melting waxes and ion exchange resins.

One can dilute the vehicle-conjugated unconjugated CGRP peptide antagonists or increase the volume of the pharmaceutical compositions of the invention with an inert material. Such diluents can include carbohydrates, especially, mannitol, α-lactose, anhydrous lactose, cellulose, sucrose, modified dextrans and starch. Certain inorganic salts may also be used as fillers, including calcium triphosphate, magnesium carbonate and sodium chloride. Some commercially available diluents are Fast-Flo, Emdex, STA-Rx 1500, Emcompress and Avicell.

A variety of conventional thickeners are useful in creams, ointments, suppository and gel configurations of the pharmaceutical composition, such as, but not limited to, alginate, xanthan gum, or petrolatum, may also be employed in such configurations of the pharmaceutical composition of the present invention. A permeation or penetration enhancer, such as polyethylene glycol monolaurate, dimethyl sulfoxide, N-vinyl-2-pyrrolidone, N-(2-hydroxyethyl)-pyrrolidone, or 3-hydroxy-N-methyl-2-pyrrolidone can also be employed. Useful techniques for producing hydrogel matrices are known. (E.g., Feijen, Biodegradable hydrogel matrices for the controlled release of pharmacologically active agents, U.S. Pat. No. 4,925,677; Shah et al., Biodegradable pH/thermosensitive hydrogels for sustained delivery of biologically active agents, WO 00/38651 A1). Such biodegradable gel matrices can be formed, for example, by crosslinking a proteinaceous component and a polysaccharide or mucopolysaccharide component, then loading with the inventive composition of matter to be delivered.

Liquid pharmaceutical compositions of the present invention that are sterile solutions or suspensions can be administered to a patient by injection, for example, intramuscularly, intrathecally, epidurally, intravascularly (e.g., intravenously or intraarterially), intraperitoneally or subcutaneously. (See, e.g., Goldenberg et al., Suspensions for the sustained release of proteins, U.S. Pat. No. 6,245,740 and WO 00/38652 A1). Sterile solutions can also be administered by intravenous infusion. The vehicle-conjugated or unconjugated CGRP peptide antagonist can be included in a sterile solid pharmaceutical composition, such as a lyophilized powder, which can be dissolved or suspended at a convenient time before administration to a patient using sterile water, saline, buffered saline or other appropriate sterile injectable medium.

Implantable sustained release formulations are also contemplated embodiments of the inventive pharmaceutical compositions. For example, the pharmaceutically acceptable carrier, being a biodegradable matrix implanted within the body or under the skin of a human or non-human vertebrate, can be a hydrogel similar to those described above. Alternatively, it may be formed from a poly-alpha-amino acid component. (Sidman, Biodegradable, implantable drug delivery device, and process for preparing and using same, U.S. Pat. No. 4,351,337). Other techniques for making implants for delivery of drugs are also known and useful in accordance with the present invention.

Additionally (or alternatively), the present invention provides pharmaceutical compositions for use in any of the various slow or sustained release formulations or microparticle formulations known to the skilled artisan, for example, sustained release microparticle formulations, which can be administered via pulmonary, intranasal, or subcutaneous delivery routes.

In a further embodiment, the inventive pharmaceutical composition is configured as a part of a pharmaceutically acceptable transdermal or transmucosal patch or a troche. Transdermal patch drug delivery systems, for example, matrix type transdermal patches, are known and useful for practicing some embodiments of the present pharmaceutical compositions. (E.g., Chien et al., Transdermal estrogen/progestin dosage unit, system and process, U.S. Pat. Nos. 4,906,169 and 5,023,084; Cleary et al., Diffusion matrix for transdermal drug administration and transdermal drug delivery devices including same, U.S. Pat. No. 4,911,916; Teillaud et al., EVA-based transdermal matrix system for the administration of an estrogen and/or a progestogen, U.S. Pat. No. 5,605,702; Venkateshwaran et al., Transdermal drug delivery matrix for coadministering estradiol and another steroid, U.S. Pat. No. 5,783,208; Ebert et al., Methods for providing testosterone and optionally estrogen replacement therapy to women, U.S. Pat. No. 5,460,820).

A variety of pharmaceutically acceptable systems for transmucosal delivery of therapeutic agents are also known in the art and are compatible with the practice of the present invention. (E.g., Heiber et al., Transmucosal delivery of macromolecular drugs, U.S. Pat. Nos. 5,346,701 and 5,516,523; Longenecker et al., Transmembrane formulations for drug administration, U.S. Pat. No. 4,994,439). Transmucosal delivery devices may be in free form, such as a cream, gel, or ointment, or may comprise a determinate form such as a tablet, patch or troche. For example, delivery of the inventive CGRP peptide antagonist can be via a transmucosal delivery system comprising a laminated composite of, for example, an adhesive layer, a backing layer, a permeable membrane defining a reservoir containing the vehicle-conjugated or unconjugated CGRP peptide antagonist, a peel seal disc underlying the membrane, one or more heat seals, and a removable release liner. (E.g., Ebert et al., Transdermal delivery system with adhesive overlay and peel seal disc, U.S. Pat. No. 5,662,925; Chang et al., Device for administering an active agent to the skin or mucosa, U.S. Pat. Nos. 4,849,224 and 4,983,395).

Alternatively, among known tablet or patch systems configured for therapeutic delivery through the oral mucosa (e.g., sublingual mucosa), some embodiments can comprise an inner layer containing the vehicle-conjugated or unconjugated CGRP peptide antagonist, a permeation enhancer, such as a bile salt or fusidate, and a hydrophilic polymer, such as hydroxypropyl cellulose, hydroxypropyl methylcellulose, hydroxyethyl cellulose, dextran, pectin, polyvinyl pyrrolidone, starch, gelatin, or any number of other polymers known to be useful for this purpose. This inner layer can have one surface adapted to contact and adhere to the moist mucosal tissue of the oral cavity and can have an opposing surface adhering to an overlying non-adhesive inert layer. Optionally, such a transmucosal delivery system can be in the form of a bilayer tablet, in which the inner layer also contains additional binding agents, flavoring agents, or fillers. Some useful systems employ a non-ionic detergent along with a permeation enhancer. These examples are merely illustrative of available transmucosal therapeutic delivery technology and are not limiting of the present invention.

In other embodiments, the inventive composition of matter and/or pharmaceutical composition can be administered to a patient orally. Compositions suitable for oral administration include solid forms, such as tablets, pills, capsules, caplets, granules, tablets, troches, lozenges, cachets, pellets and powders, and liquid forms, such as solutions, syrups, elixirs, and suspensions. Forms useful for enteral administration include sterile solutions, emulsions, and suspensions. Examples of oral solid dosage forms are further described generally in Chapter 89 of Remington's Pharmaceutical Sciences, 18th ed., Mack Publishing Co., Easton Pa. 18042, (1990).

Also, liposomal or proteinoid encapsulation may be used to formulate the inventive pharmaceutical compositions for oral administration (as, for example, proteinoid microspheres reported in U.S. Pat. No. 4,925,673; see also Giovagnoli et al., Biodegradable microspheres as carriers for native superoxide dismutase and catalase delivery, AAPS PharmSciTech, 5(4), Article 51, (% vww.aapspharmscitech.org) (2004)). Liposomal encapsulation can include derivatization with various polymers. (e.g., U.S. Pat. No. 5,013,556). A further description of possible solid dosage forms suitable for the pharmaceutical composition is given in Chapter 10 of Marshall, K., Modern Pharmaceutics, G. S. Banker and C. T. Rhodes, eds. (1979).

If necessary, the compositions containing the CGRP peptide antagonists of the invention may be chemically modified so that oral delivery is efficacious. Generally, the chemical modification contemplated is the attachment of at least one moiety to the compound molecule itself, wherein the moiety permits (a) inhibition of proteolysis or acid hydrolysis in the gastric environment; and (b) uptake into the blood stream from the stomach or intestine. Also desired is the increase in overall stability of the vehicle-conjugated or unconjugated CGRP peptide antagonists and increase in circulation time in the body. Accordingly, moieties useful as conjugated vehicles in this invention may also be used for this purpose. Examples of such moieties include: PEG, copolymers of ethylene glycol and propylene glycol, carboxymethyl cellulose, dextran, polyvinyl alcohol, polyvinyl pyrrolidone and polyproline. See, for example, Abuchowski and Davis, Soluble Polymer-Enzyme Adducts, Enzymes as Drugs, Hocenberg and Roberts, eds., Wiley-Interscience, New York, N.Y., 367-383 (1981); Newmark, et al., J. Appl. Biochem., 4:185-189 (1982). Other polymers that could be used are poly-1,3-dioxolane and poly-1,3,6-tioxocane. Preferred for pharmaceutical usage, as indicated above, are PEG moieties. It is also possible to use a salt of a modified aliphatic amino acid, such as sodium N-(8-[2-hydroxybenzoyl]amino) caprylate (SNAC), as a carrier to enhance absorption of the CGRP peptide antagonists of the invention. (See, e.g., U.S. Pat. No. 5,792,451, entitled "Oral Drug Delivery Composition and Methods".

The compositions containing the CGRP peptide antagonists of the invention can be included in the formulation of the pharmaceutical composition for oral administration as fine multi-particulates in the form of granules or pellets. The formulation of the material for capsule administration can also be as a powder, as lightly compressed plugs, or even as tablets.

Controlled release oral formulations of the pharmaceutical composition may be desirable. The compositions of matter and/or pharmaceutical compositions of the invention can be incorporated into an inert matrix which permits release by either diffusion or leaching mechanisms e.g., gums. Slowly degenerating matrices may also be incorporated into the formulation, e.g., alginates, polysaccharides. For example, the pharmaceutical compositions can be coated by the techniques described in U.S. Pat. Nos. 4,256,108; 4,160,452; and 4,265,874, to form osmotic therapeutic tablets for controlled release. Other techniques for controlled release compositions, such as those described in the U.S. Pat. Nos. 4,193,985; and 4,690,822; 4,572,833 can be used in the formulation of the inventive pharmaceutical compositions. Another form of a controlled release of the vehicle-conjugated or unconjugated CGRP peptide antagonists and/or pharmaceutical compositions of this invention is by a method based on the Oros therapeutic system (Alza Corp.), i.e., the inventive CGRP peptide antagonists and/or pharmaceutical compositions are enclosed in a semi-permeable membrane which allows water to enter and push drug out through a single small opening due to osmotic effects. Some enteric coatings also have a delayed release effect.

Other coatings may be used for the formulation for oral administration. These include a variety of sugars which can be applied in a coating pan. The therapeutic agent could also be given in a film-coated tablet and the materials used in this instance are divided into 2 groups. The first are the nonenteric materials and include methyl cellulose, ethyl cellulose, hydroxyethyl cellulose, methylhydroxy-ethyl cellulose, hydroxypropyl cellulose, hydroxypropyl-methyl cellulose, sodium carboxy-methyl cellulose, providone and the polyethylene glycols. The second group consists of the enteric materials that are commonly esters of phthalic acid. A mix of materials might be used to provide the optimum film coating. Film coating may be carried out in a pan coater or in a fluidized bed or by compression coating.

Pulmonary administration to a patient of the vehicle-conjugated or unconjugated CGRP peptide antagonists and/or pharmaceutical compositions is also useful, in accordance with the present invention. The CGRP peptide antagonists are delivered to the lungs of a patient by inhalation and traverse across the lung epithelial lining to the blood stream. (See, also, Adjei et al., Pharma. Res., 7:565-569 (1990); Adjei et al., Int'l. J. Pharmaceutics, 63:135-44 (1990), leuprolide acetate; Braquet et al., J. Cardio. Pharmacol. 13(5):143-146 (1989), endothelin-1; Hubbard et al., Annals Int. Med., 3:206-212 (1989), α1-antitrypsin; Smith et al., J. Clin. Invest., 84:1145-1146 (1989), α1-proteinase; Oswein et al., "Aerosolization of Proteins", Proc. Symp. Resp. Drug Delivery II, Keystone, Colo., (March 1990), recombinant human growth hormone; Debs et al., J. Immunol., 140:3482-3488 (1988), interferon-γ and tumor necrosis factor α; and Platz et al., U.S. Pat. No. 5,284,656 (granulocyte colony stimulating factor)).

Useful in the practice of the present invention are a wide range of mechanical inhalant dispensing devices (i.e., inhaler devices) designed for pulmonary administration of therapeutic products, including but not limited to nebulizers, metered dose inhalers, and powder inhalers, all of which are familiar to those skilled in the art. Some specific examples of commercially available devices suitable for the practice of this invention are the Ultravent nebulizer, manufactured by Mallinckrodt, Inc., St. Louis, Mo.; the Acorn 11 nebulizer, manufactured by Marquest Medical Products, Englewood, Colo.; the Ventolin metered dose inhaler, manufactured by Glaxo Inc., Research Triangle Park, N.C.; and the Spinhaler powder inhaler, manufactured by Fisons Corp., Bedford, Mass. (See, e.g., Helgesson et al., Inhalation device, U.S. Pat. No. 6,892,728; McDerment et al., Dry powder inhaler, WO 02/11801 A1; Ohki et al., Inhalant indicator, U.S. Pat. No. 6,273,086).

All such inhalant dispensing devices require the use of formulations suitable for the dispensing of the inventive composition of matter. Typically, each formulation is specific to the type of inhalant dispensing device employed and may involve the use of an appropriate aerosol propellant material, in addition to diluents, adjuvants and/or carriers useful in therapy.

For pulmonary administration of such inhalant formulations of the pharmaceutical composition, the inventive pharmaceutical composition should most advantageously be prepared in microparticle form with an average aerodynamic diameter of about 0.5 to 5 μm, for most effective delivery to the distal lung.

Pharmaceutically acceptable carriers suitable for such inhalant formulations include carbohydrates such as trehalose, mannitol, xylitol, sucrose, lactose, and sorbitol. Other ingredients for use in formulations may include DPPC, DOPE, DSPC and DOPC. Natural or synthetic surfactants may be used. PEG may be used (even apart from its use as a vehicle to be conjugated to the CGRP peptide antagonist). Dextrans, such as cyclodextran, may be used. Bile salts and other related enhancers may be used. Cellulose and cellulose derivatives may be used. Amino acids may be used, such as use in a buffer formulation. Also, the use of liposomes, microcapsules or microspheres, inclusion complexes, or other types of carriers is contemplated for some inhalant formulations.

Formulations suitable for use with a nebulizer, either jet or ultrasonic, will typically comprise the inventive composition of matter dissolved in water. The formulation may also include a buffer and a simple sugar (e.g., for peptide stabilization and regulation of osmotic pressure). The nebulizer formulation may also contain a surfactant, to reduce or prevent surface induced aggregation of the protein caused by atomization of the solution in forming the aerosol.

Formulations for use with a metered-dose inhaler device will generally comprise a finely divided powder containing the inventive compound suspended in a propellant with the aid of a surfactant. The propellant may be any conventional material employed for this purpose, such as a chlorofluorocarbon, a hydrochlorofluorocarbon, a hydrofluorocarbon, or a hydrocarbon, including trichlorofluoromethane, dichlorodifluoromethane, dichlorotetrafluoroethanol, or 1,1,1,2-tetrafluoroethane, or combinations thereof. Suitable surfactants include sorbitan trioleate and soya lecithin. Oleic acid may also be useful as a surfactant. (See, e.g., Bäckström et al., Aerosol drug formulations containing hydrofluoroalkanes and alkyl saccharides, U.S. Pat. No. 6,932,962).

Formulations for dispensing from a powder inhaler device will comprise a finely divided dry powder containing the inventive compound and may also include a bulking agent, such as lactose, sorbitol, sucrose, mannitol, trehalose, or xylitol in amounts which facilitate dispersal of the powder from the device, e.g., 50 to 90% by weight of the formulation. (See, e.g., McDerment et al., Dry powder inhaler, WO 02/11801 A1).

In accordance with the present invention, intranasal delivery of the inventive composition of matter and/or pharmaceutical compositions is also useful, which allows passage thereof to the blood stream directly after administration to the inside of the nose, without the necessity for deposition of the product in the lung. Formulations suitable for intranasal administration include those with dextran or cyclodextran, and intranasal delivery devices are known. (See, e.g., Freezer, Inhaler, U.S. Pat. No. 4,083,368).

As used in the specification and the appended claims, the singular forms "a", "an", and "the" include plural referents unless the context clearly dictates otherwise. Thus, for example, reference to "a vehicle-conjugated CGRP peptide antagonist" or "a vehicle-conjugated CGRP peptide antagonist" includes mixtures of such conjugates and reference to "the method of treatment" includes reference to one or more methods of treatment of the type which will be known to those skilled in the art or will become known to them upon reading this specification, and so forth.

The invention will be described in greater detail by reference to the following examples. These examples are not to be construed in any way as limiting the scope of the present invention.

EXAMPLES

Example 1

CGRP peptide synthesis CGRP$_1$ binding and antagonist activity. A series of CGRP peptide analogs were synthesized by conventional solid phase peptide synthetic techniques for the purpose of introducing site-selective conjugation sites for activated vehicle.

Several conjugation strategies were explored including thiol-mediated alkylation as well as reductive alkylation and acylation. Also site-selective conjugation sites were engineered at the CGRP peptide N-terminus or within the hinge region.

CGRP peptide synthesis. The following protocol was used to generate CGRP analogs as described herein. N$^\alpha$-Fmoc, side-chain protected amino acids and Rink amide resin were used. Representative side-chain protection strategies were: Asp(OtBu), Arg(Pbf), Cys(Acin), Glu(OtBu), Glu(O2-PhiPr), His(Trt), Lys(N$^\epsilon$-Boc), Lys(N$^\epsilon$-Mtt), Ser(OtBu), Thr(OtBu), Trp(Boc) and Tyr(OtBu). CGRP peptide derivatives were synthesized in a stepwise manner on an ABI433 peptide synthesizer by SPPS using O-Benzotriazole-N,N,N',N'-tetramethyl-uronium-hexafluoro-phosphate (HBTU)/N,N-diisopropylethylamine (DIEA)/N,N-dimethylformamide (DMF) coupling chemistry at 0.2 mmol equivalent resin scale (Fmoc-deprotected Rink amide resin). For each coupling cycle, 1 mmol N$^\alpha$-Fmoc-amino acid, 4 mmol DIEA and 1 mmol equivalents of HBTU were used. The concentration of the HBTU-activated Fmoc amino acids was 0.5 M in DMF, and the coupling time was 45 min. Fmoc deprotections were carried out with two treatments using a 30% piperidine in DMF solution first for 2 min and then for an additional 20 min.

Lactam Formation. In some embodiments of the CGRP peptides, side-chain to side-chain lactam formation was carried out on the assembled N-terminally Fmoc-protected peptide resin. The peptide-resin was solvated in DCM for 30 mins, and drained. The Mtt and 2-PhiPr groups (protecting group at the specified lactam bond forming sites) were removed with 1% TFA in DCM solution containing 5% TIS. Treatment of the peptide-resin with the 1% TFA in DCM solution was repeated 8 times in 30 min increments, and each treatment was followed by extensive DCM washes. The liberate carboxyl and amino groups were then condensed by the addition of 5 equiv of 0.5M benzotriazole-1-yl-oxy-tris-pyrrolidino-phosphonium hexafluorophosphate (PyBOP) and 10 equiv of DIEA in DMF were added to the peptide resin, and left for 24 h. The resin was then wash thoroughly with DMF, DCM, and DCM/MeOH, and dried.

Side Chain Deprotection and Cleavage from Resin. Following synthesis and modification, the resin was then drained, and washed with DCM, DMF, DCM, and then dried in vacuo. The peptide-resin was deprotected and released from the resin by treatment with a trifluoroacetic acid (TFA)/1,2-ethanedithiol (EDT)/triisopropyl-silane (TIS)/H$_2$O (92.5:2.5:2.5:2.5 v/v) solution at room temperature for 90 min. The volatiles were then removed with a stream of nitrogen gas, the crude peptide precipitated twice with diethyl ether and collected by centrifugation.

Reversed-Phase HPLC Purification. Reversed-phase high-performance liquid chromatography was performed on an analytical (C18, 5 μm, 0.46 cm×25 cm) or a preparative (C18, 10 μm, 2.2 cm×25 cm) column. Chromatographic separations were achieved using linear gradients of buffer B in A (A=0.1% aqueous TFA; B=90% aq. ACN containing 0.09% TFA) typically 5-95% over 35 min at a flow rate of 1 mL/min for analytical analysis and 5-65% over 90 min at 20 mL/min for preparative separations. Analytical and preparative HPLC fractions were characterized by ESMS and photodiode array (PDA) HPLC, and selected fractions combined and lyophilized.

CGRP$_1$ binding experiments. CGRP$_1$ binding assays were set up in 96-well plates at room temperature containing: 110 μl binding buffer (20 mM Tris-HCl, pH7.5, 5.0 mM MgSO$_4$, 0.2% BSA [Sigma], 1 tablet of Complete™/50 ml buffer [protease inhibitor]); 20 μl test compound (10×); 20 μl $^{125}$I-hαCGRP (Amersham Biosciences) (10×); and 50 μl human neuroblastoma cell (SK-N-MC) membrane suspension (10 μg per well, PerkinElmer). The plates were incubated at room temperature for 2 hour with shaking at 60 rpm, then the contents of each well were filtered over 0.5% polyethyleneimine (PEI)-treated (at least one hour) GF/C 96-well filter plates. The GF/C filter plates were washed 6 times with ice-cold 50 mM Tris, pH 7.5 and dried in an oven at 55 C for 1 hour. The bottoms of the GF/C plates were then sealed, and 40 μl Microscint™ 20 was added to each well, then the tops of the GF/C plates were sealed with TopSeal™-A, a press-on adhesive sealing film, and the GF/C plates were counted with TopCount NXT (Packard). The data were analyzed by using ActivityBase (IDBS) or Prizm (GraphPad) software. Results of binding assays are shown in Table 3A and Table 3B below.

TABLE 3A

CGRP₁ binding experiment results.

| SEQ ID NO | Sequence | Ki (nM) |
|---|---|---|
| 31 | Ac-WVTH(Cit)LAGLLS(Cit)SGGVVRKNFVPTDVGPFAF-NH₂ | 0.46 |
| 79 | 120 K PEG (ald)-Ac-WVTH[Cit]LAGLLS[Cit]SGGVVRKNFVPTDVGPFAF-NH2 | 1.83 |
| 158 | Ac-WVTH[Cit]LAGLLS[Cit]SGGVVRK(20 KPEGald)NFVPTDVGPFAF-NH2 | 2.61 |
| 739 | Ac-WVTH[Cit]LAGLLS[Cit]SGGVV[hArg]KNFVPTDVGPFAF-NH2 | 0.53 |
| 153 | Ac-WVTH[Cit]LAGLLS[Cit]SGGVV[hArg]K(20 K PEGald)NFVPTDVGPFAF-NH2 | 1.78 |
| 171 | Ac-WVTH[Cit]LAGLLS[Cit]SGGVV[hArg]K(20 KPEGald)NFVPTDVGPFAF-NH2 | 1.27 |
| 658 | Ac-WVTH[Cit]LAGLLS[Cit]SGGVV[hArg]KNFVPTDVG[Oic]FAF-NH2 | 0.73 |
| 172 | Ac-WVTH[Cit]LAGLLS[Cit]SGGVV[hArg]K(20 KPEGald)NFVPTDVG[Oic]FAF-NH2 | 1.27 |
| 674 | Ac-VWTH[Cit]LAGLLS[Cit]SGGVV[hArg]KNFVPTDVGP[1-Nal]AF-NH2 | 0.64 |
| 173 | Ac-WVTH[Cit]LAGLLS[Cit]SGGVV[hArg]K(20 KPEGald)NFVPTDVGP[1-Nal]AF-NH2 | 0.84 |

TABLE 3B

CGRP₁ binding experiment results.

| SEQ ID NO | CGRP Peptide Sequence | Ki (nM) |
|---|---|---|
| 6 | Ac-VTHRLAGLLSRSGGVVRKNFVPTDVGPFAF-amide | 0.04 |
| 229 | Ac-VTHRLAGLLSRSGGVVRK $^{(5\ kDa\ PEG)}$NFVPTDVGPFAF-amide | 0.06 |
| 230 | Ac-VTHRLAGLLSRSGGVVRK $^{(20\ kDa\ PEG)}$NFVPTDVGPFAF-amide | 0.17 |
| 231 | Ac-WVTHRLAGLLSRSGGVVKC $^{(20\ kDa\ PEG)}$NFVPTDVGPFAF-amide | 0.27 |
| 232 | Ac-WVTHRLAGLLSRSGGVVKC $^{(30\ kDa\ PEG)}$NFVPTDVGPFAF-amide | 0.27 |
| 5 | Acyl-WVTHRLAGLLSRSGGVVRKNFVPTDVGPFAF-NH2 | 0.06 |
| 677 | Ac-WVTHRLAGLLSRSGGVVRK $^{(20\ kDa\ PEG)}$NFVPTDVGPFAF-amide | 0.57-13.17 |
| 680 | Ac-WVTHRLAGLLSRSGGVVRCNFVPTDVGPFAF-amide | 0.58 |
| 681 | Ac-WVTHRLAGLLSRSGGVVRC $^{(20\ kDa\ PEG)}$NFVPTDVGPFAF-amide | 0.60 |
| 682 | Ac-WVTHRLAGLLSRSGGVVCNNFVPTDVGPFAF-amide | 0.34 |
| 683 | Ac-WVTHRLAGLLSRSGGVVC $^{(20\ kDa\ PEG)}$NNFVPTDVGPFAF-amide | 1.58 |
| 684 | Ac-WVTHRLAGLLSRSGGVVKNNFVPTDVGPFAF-amide | 0.08 |
| 685 | Ac-WVTHRLAGLLSRSGGVVK $^{(20\ kDa\ PEG)}$NNFVPTDVGPFAF-amide | 155.30 |
| 686 | Ac-WVTHRLAGLLSRSGGVVK $^{(20\ kDa\ PEG)}$NNFVPTDVGPFAF-amide | 1.33 |
| 687 | Ac-WVTHRLAGLLSRSGGVVK $^{(20\ kDa\ PEG)}$NNFVPTDVGPFAF-amide | 0.49 |
| 688 | WVTHRLAGLLSRSGGVVKCNFVPTNVGSKAF-NH2 | 11.69 |
| 689 | WVTHRLAGLLSRSGGVVKCNFVPTDVGPFAF-NH2 | 0.95 |
| 690 | C $^{(5\ kDa\ MeO-PEG)}$GGGGGGGVTHRLAGLLSRSGGVVKNNFVPTNVGSKAF-amide | 3072.00 |
| 691 | VTHRLAGLLSRSGGVVC $^{(5\ kDa\ MeO-PEG)}$NNFVPTNVGSKAF-NH2 | 157.42 |
| 692 | C $^{(5\ kDa\ PEG)}$GGGGGGGVTHRLAGLLSRSGGVVKNNFVPTDVGPFAF-amide | 20.84 |
| 693 | VTHRLAGLLSRSGGVVKC $^{(5\ kDa\ MeO-PEG)}$NFVPTNVGSKAF-amide | 17.50 |

TABLE 3B-continued

CGRP₁ binding experiment results.

| SEQ ID NO | CGRP Peptide Sequence | Ki (nM) |
|---|---|---|
| 694 | VTHRLAGLLSRSGGVVKC<sup>(5 kDa MeO-PEG)</sup>NFVPTNVGSKAF-amide | 31.80 |
| 695 | WVTHRLAGLLSRSGGVVKC<sup>(5 kDa MeO-PEG)</sup>NFVPTNVGSKAF-amide | 5.44 |
| 696 | WVTHRLAGLLSRSGGVVKC<sup>(5 kDa MeO-PEG)</sup>NFVPTDVGPFAF-amide | 0.21 |
| 697 | C<sup>(5 kDa MeO-PEG)</sup>GGGGGGGWVTHRLAGLLSRSGGVVKNNFVPTDVGPFAF-amide | 5.74 |
| 698 | Bzl-VTHRLAGLLSRSGGVVKNNFVPTNVGSKAF-NH2 | >1000 |
| 699 | Bn-VTHRLAGLLSRSGGVVKNNFVPTNVGSKAF-NH2 | 3.24 |
| 700 | Bn-VTHRLAGLLSRSGGVVKNNFVPTDVGPFAF-NH2 | 0.22 |
| 701 | [1-Nal]VTHRLAGLLSRSGGVVKNNFVPTDVGPFAF-NH2 | 0.14 |
| 702 | Bn₂-VTHRLAGLLSRSGGVVKNNFVPTDVGPFAF-NH2 | 0.23 |
| 703 | [Phg]VTHRLAGLLSRSGGVVKNNFVPTDVGPFAF-NH2 | 0.19 |
| 704 | [Cha]VTHRLAGLLSRSGGVVKNNFVPTDVGPFAF-NH2 | 0.20 |
| 705 | Ac-VTHRLAGLLSRSGGVVKNNFVPTDVGPFAF-NH2 | 0.73 |
| 706 | Ac-VTHRLAGLLSRSGGVVKNNFVPTDVGPFAF-NH2 | 0.24 |
| 707 | ASDTATC(Acm)VTHRLAGLLSRSGGVVKNNFVPTNVGSKAF-NH2 | 20.80 |
| 708 | Ac(Acm)DTATSVTHRLAGLLSRSGGVVKNNFVPTNVGSKAF-NH2 | 23.99 |
| 709 | ASDTATSVTHRLAGLLSRSGGVVKNNFVPTNVGSKAF-NH2 | 12.05 |
| 710 | C(εAhx)FVPTDVGPFAF-NH2 | 12.67 |
| 711 | FVPTDvGPFAF-NH2 | >1000 |
| 712 | FVPTDVGPfAF-NH2 | >1000 |
| 713 | FVPTDVGpFAF-NH2 | >1000 |
| 714 | fVPTDVGPFAF-NH2 | 12.79 |
| 715 | FVPTDVGPFaF-NH2 | >1000 |
| 716 | FvPTDVGPFAF-NH2 | 30.2 |
| 717 | FVPTDVAPFAF-NH2 | >1000 |
| 718 | FVpTDVGPFAF-NH2 | 21.58 |
| 719 | FVPTdVGPFAF-NH2 | >1000 |
| 720 | FVPTDVGPFAf-NH2 | >1000 |
| 721 | CGGGGGGGFVPTDVGPFAF-NH2 | 7.34 |
| 722 | aCDTATCVTHRLAGLLSRSGGVVKNNFVPTNVGSKAF-NH2 | 0.09 |
| 723 | AcDTATCVTHRLAGLLSRSGGVVKNNFVPTNVGSKAF-NH2 | 0.26 |
| 724 | ACdTATCVTHRLAGLLSRSGGVVKNNFVPTNVGSKAF-NH2 | 1.73 |
| 725 | ACDtATCVTHRLAGLLSRSGGVVKNNFVPTNVGSKAF-NH2 | 3.25 |
| 726 | ACDTaTCVTHRLAGLLSRSGGVVKNNFVPTNVGSKAF-NH2 | 0.12 |
| 728 | ACDTAtCVTHRLAGLLSRSGGVVKNNFVPTNVGSKAF-NH2 | 7.84 |
| 729 | ACDTATcVTHRLAGLLSRSGGVVKNNFVPTNVGSKAF-NH2 | 0.52 |

TABLE 3B-continued

CGRP₁ binding experiment results.

| SEQ ID NO | CGRP Peptide Sequence | Ki (nM) |
|---|---|---|
| 730 | ACDTATCvTHRLAGLLSRSGGVVKNNFVPTNVGSKAF-NH2 | 11.75 |
| 731 | ACDTATCVThRLAGLLSRSGGVVKNNFVPTNVGSKAF-NH2 | 0.67 |
| 732 | ACDTATCVtHRLAGLLSRSGGVVKNNFVPTNVGSKAF-NH2 | 0.07 |

CGRP antagonist activity. The un-conjugated CGRP peptide analogs were screened in an in vitro CGRP₁ receptor mediated cAMP assay to determine intrinsic potency prior to vehicle conjugation.

Table 3 (herein below) shows the results of such in vitro cAMP-based assays comparing native human αCGRP(8-37) peptide antagonist (Table 3, SEQ ID NO:1) with a variety of other analogs designed to enhance potency at the CGRP$_1$ receptor, permit site-selective conjugation and/or facilitate handling in vitro. The in vitro cAMP assay employed a human neuroblastoma-derived cell line (SK-N-MC). SK-N-MC cells express CRLR and RAMP1, which form CGRP$_1$ receptor. CGRP$_1$ receptor is a G-protein coupled receptor linked to the stimulatory G-protein, $G_s$. Upon CGRP binding to the receptor, cAMP levels increase, mediated by G, activation of adenylyl cyclase and cAMP-dependent protein kinase (PKA). An ELISA assay was developed to measure the level of cAMP accumulated in treated SK-N-MC cells as a screening system for the identification of CGRP antagonists. Briefly, two days before the assay, the cells were plated in 96-well plates in growth medium. On the day of the assay cells were rinsed with PBS followed by the addition of 60 μl of plasma free medium for 15 minutes at room temperature. CGRP peptide antagonists were then added at varying concentrations in 20 μl buffer followed by a 5 minute incubation at 37° C. The CGRP agonist, αCGRP, was then added in 20 μl buffer to each well followed by a 5 minute incubation at 37° C. The medium was then removed and the cells were lysed with 100 μl lysis buffer for 30 minutes at 37° C. for 30 minutes. Using a Tropix ELISA kit (Applied Biosystems, Foster City, Calif.), a cAMP-AP conjugate was diluted (1:100) and added (30 μl) to each well of a 96-well ELISA plate. An aliquot of the lysis buffer from the cell plate was then added to the ELISA plate followed by an aliquot of the cAMP antibody. This mixture was incubated for 1 hour at room temperature with gentle shaking. The ELISA plate was then washed 6× with wash buffer followed by the additions of a substrate enhancer. This mixture was incubated for 30 minutes at room temperature and then read on a MicroBeta Jet or EnVision plate reader. The results were analyzed using Prism (GraphPad).

Initial conjugation strategies included engineering an N-terminal cysteine with a hepta-glycine linker to native CGRP(8-37) antagonist for thiol mediated coupling at the N-terminus. This addition to the N-terminus of the CGRP peptide proved deleterious to potency at the CGRP$_1$ receptor (Table 3, SEQ ID NO:2 compared to SEQ ID NO:1). Unexpectedly, we discovered that addition of three amino acid substitutions (T30D, V32P and G33F), used to restore activity in the truncated CGRP peptide antagonist, not only restored activity to the N-terminal conjugation analog (Table 3, SEQ ID NO:3), but improved potency more than 6-fold relative to the native CGRP(8-37) peptide antagonist (Table 3, SEQ ID NO:1). This result was unexpected since the three amino acid substitutions were described as necessary for activation of the truncated CGRP(28-37), in which context they were proposed to compensate for the missing CGRP$_1$ receptor binding region at CGRP(8-18). (Rist et al., From Micromolar to Nanomolar Affinity: A systematic approach to identify the binding site of CGRP at the human calcitonin gene-related peptide 1 receptor, J. Med. Chem., 41:117-123 (1998)). Thus the introduction of three amino acid substitutions (T30D, V32P and G33F) significantly improved the potency of full-length CGRP(8-37) peptide antagonist analogs.

The benefit of the three amino acid substitutions (T30D, V32P and G33F) was again observed when a tryptophan (W7, relative to the native human αCGRP sequence) was added to the N-terminus of CGRP(8-37) (Table 3, SEQ ID NO:4 and SEQ ID NO:5), which usefully incorporated a chromophore into the CGRP sequence to allow better in-process monitoring and quantitation using spectroscopic methods. Remarkably, the W7 addition alone (Table 3, SEQ ID NO:4) significantly improved the potency of the analog by greater than 7-fold relative to the native αCGRP(8-37) peptide sequence (Table 3, SEQ ID NO:1). The combination of all four modifications (Table 3, SEQ ID NO:5) achieved a greater than 35-fold improved antagonist activity over αCGRP(8-37).

With the four amino acid substitutions (W7, T30D, V32P and G33F) and the N-terminus acetylated (Table 3, SEQ ID NO:5), there remained only one primary amine in the CGRP hinge region at K24 (relative to the native human αCGRP sequence) to serve as a reactive nucleophile for conjugation. Additional analogs (e.g., Table 3, SEQ ID NO:6 and SEQ ID NO:7) were designed in this context by converting K24R and N25K to move over the conjugation site one residue in the direction of the C-terminus and to restore the positive charge of a basic residue to position 24 (relative to the native human αCGRP sequence). Unmodified, these analogs showed a similar antagonist activity to the analog containing a native hinge region sequence (Table 3, SEQ ID NO:5). Also, comparison of analogs SEQ ID NO:6 and SEQ ID NO:7 (in Table 3) again demonstrates the unexpected beneficial effects of the N-terminal tryptophan.

The effect of conjugation at amino acid positions 24 or 25 (relative to the native human αCGRP sequence) was also evaluated (see, e.g., Table 4) using cysteine substitutions to introduce a reactive thiol at these positions (Table 3, SEQ ID NO:8 and SEQ ID NO:9). Surprisingly, these analogs were somewhat less active than the equivalent lysine and arginine analogs at the same positions.

Finally, position 23 (relative to the native human αCGRP sequence) was also evaluated as a potential conjugation site using V23C, K24R (Table 3, SEQ ID NO:10) or V23K, K24R (Table 3, SEQ ID NO:11).

TABLE 3

In vitro CGRP$_1$ receptor-mediated cAMP assays (n = 2-4) comparing native human αCGRP(8-37) peptide antagonist (SEQ ID NO:1) with a variety of CGRP peptide analogs. Modifications to the native human αCGRP sequence within each analog are shown in boldface.

| SEQ ID NO: | Sequence | IC$_{50}$ (nM) |
|---|---|---|
| 1 | VTHRLAGLLSRSGGVVKNNFVPTNVGSKAF-NH$_2$ | 4.94 |
| 2 | CGGGGGGGVTHRLAGLLSRSGGVVKNNFVPTNVGSKAF-NH$_2$ | 21.11 |
| 3 | CGGGGGGGVTHRLAGLLSRSGGVVKNNFVPTDVGPFAF-NH$_2$ | 0.72 |
| 4 | WVTHRLAGLLSRSGGVVKNNFVPTNVGSKAF-NH$_2$ | 0.64 |
| 5 | Ac-WVTHRLAGLLSRSGGVVKNNFVPTDVGPFAF-NH$_2$ | 0.14 |
| 6 | Ac-VTHRLAGLLSRSGGVVRKNFVPTDVGPFAF-NH$_2$ | 0.70 |
| 7 | Ac-WVTHRLAGLLSRSGGVVRKNFVPTDVGPFAF-NH$_2$ | 0.13 |
| 8 | Ac-WVTHRLAGLLSRSGGVVRCNFVPTDVGPFAF-NH$_2$ | 0.50 |
| 9 | Ac-WVTHRLAGLLSRSGGVVCNNFVPTDVGPFAF-NH$_2$ | 2.15 |
| 10 | Ac-WVTHRLAGLLSRSGGVCRNNFVPTDVGPFAF-NH$_2$ | 0.36 |
| 11 | Ac-WVTHRLAGLLSRSGGVKRNNFVPTDVGPFAF-NH$_2$ | 0.51 |
| 96 | WFVPTDVGPFAF-NH$_2$ | 21.68 |
| 97 | FVPTDVGPFAF-NH$_2$ | 17.39 |
| 45 | CGGGGGGGPTDVGPFAF-NH$_2$ | 56.57 |

Example 2

Antagonist activity by vehicle-conjugated CGRP peptide antagonists. A variety of CGRP analogs were engineered for vehicle conjugation through several different conjugating chemistries. Three monofunctional 20 kDa methoxy PEG derivatives were conjugated to the appropriate CGRP peptide analogs resulting in amine, amide or thioether linkages. The specific conjugation site was also varied to include the CGRP peptide N-terminus or amino acid positions 23, 24 or 25 (relative to the native human αCGRP sequence) in the CGRP peptide hinge region.

Table 4 (herein below) shows the results of in vitro CGRP$_1$ receptor-mediated cAMP assays comparing a variety of PEG-conjugated CGRP peptide antagonists. The amine-linked PEG-peptides were derived from CGRP peptide antagonists with their N-termini acylated and a single primary amine engineered into the designated conjugation site (Table 4, SEQ ID NOS:5, 7 and 11). The activated PEG derivative used was a 20 kDa methoxy PEG-aldehyde (in PEG-ald) and conjugation was achieved by reductive alkylation in the presence of sodium cyanoborohydride. Briefly, the CGRP peptide was dissolved at 2 mg/ml in an amine-free buffer (20 mM sodium phosphate, pH 6), the mPEG-ald was added in stoichiometric excess (about 5-fold) and sodium cyanoborohydride was added to a final concentration of 10 mM. The reaction mixture was stirred at room temperature for 24 to 48 hours and was monitored by reverse phase high-pressure liquid chromatography (RP-HPLC). Upon completion, the reaction was quenched by a 4- to 5-fold dilution into 20 mM sodium acetate buffer, pH 4. Purification was achieved by preparative cation-exchange chromatography, eluting with a linear 0-500 mM sodium chloride gradient. The eluted PEG-peptide was identified by RP-HPLC and sodium dodecyl sulfate polyacrylamide gel electrophoresis (SDS-PAGE), and was concentrated and dialyzed into 10 mM sodium acetate, 5% sorbitol, at pH 4. Purities of greater than 99% were determined for all the final pools by RP-HPLC. Peptide mapping and sequencing were used to confirm conjugation of PEG at each of the intended conjugation sites.

The amide-linked PEG-peptides were derived from the same single, primary amine containing CGRP analogs (Table 4, analogs SEQ ID NOS:5, 7 and 11) used for the amine-linked conjugates. The activated PEG derivative was a 20 kDa methoxy PEG-N-hydroxysuccinimidyl ester (mPEG-NHS), and conjugation was achieved by acylation at pH 8. Briefly, the CGRP peptide was dissolved at 2 mg/ml in an amine-free buffer (50 mM Bicine, pH 8); the mPEG-NHS was added in stoichiometric excess (2-10 fold) and was allowed to react for 4- to 24 hours at room temperature. The reaction was monitored, quenched and purified by the same method used for the amine-linked PEG-peptides, as described above. Although there was a substantial fraction of peptide that appeared to be di-PEGylated, it was easily separated in purification, and, as described above for the amine-linked PEG-peptide, the mono-PEGylated amide-linked peptide was also purified to >99% purity as determined by RP-HPLC.

Thioether-linked PEG-peptides were derived from CGRP antagonist analogs with reactive thiols engineered at the desired conjugation site (Table 4, CGRP peptide analogs SEQ ID NOS:3, 8, 9 and 10). The activated PEG derivative was a 20 kDa methoxy PEG-maleimide (mPEG-mal) and conjugation was achieved by alkylation at pH 6. Briefly, the CGRP peptide was dissolved at 2 mg/ml in an amine-free buffer (50 mM sodium phosphate, 5 mM EDTA, pH 6), the mPEG-mal was added in a modest stoichiometric excess (1.2-1.5 fold) and was allowed to react 0.5- to 2 hours at room temperature. The reaction was monitored, quenched with 5 mM β-mercaptoethanol, and after quenching was allowed to incubate at room temperature another 30 minutes. Then, thioether-linked PEG-peptides were purified by the same method used for the amine-linked PEG-peptides, as described above.

There were several unexpected results observed when these various PEG-CGRP analogs were evaluated using the in vitro cAMP assay, as described in Example 1. First, there was a very clear preference for coupling in the CGRP hinge region compared to the N-terminus. PEGylation through a thioether linkage at the N-terminus dramatically reduced the conjugate's potency by >190-fold, when compared to the unconjugated N-terminal analog (Table 4, SEQ ID NO:3). In contrast, PEGylation at an engineered cysteine in the hinge region (Table 4, SEQ ID NO:14) had little effect on the antagonist activity of the parent peptide (Table 4, SEQ ID NO:9). However, since the thioether coupling in the hinge region did not result in an especially potent conjugate, alternative chemistries were explored for coupling in the hinge region.

Using amine (Table 4, SEQ ID NO:12) and amide (Table 4, SEQ ID NO:13) linkages to PEGylate the native lysine at position 24 also gave somewhat disappointing binding results. Although the parent peptide (Table 4, SEQ ID NO:5) was quite potent, PEGylation through either of these linkages caused a greater than 15-fold loss in antagonist activity. Unexpectedly, the CGRP double substitution K24R, N25K (Table 4, SEQ ID NO:7) tolerated PEGylation by either amine or amide linkage very well, suffering only about a three-fold loss in antagonist activity (compare SEQ ID NO:7 to Table 4, SEQ ID NO:15 and SEQ ID NO:16), and these conjugates were still about 12-fold more potent than the unPEGylated native sequence CGRP(8-37) peptide (Table 4, SEQ ID NO:1). Both of these conjugates (Table 4, SEQ ID NO:15 and SEQ ID NO:16) enjoyed a significant potency benefit from engineering an unreactive basic residue (e.g., arginine) to replace the native lysine at position 24 (relative to the native human αCGRP sequence) and from moving the conjugation site lysine to position 25 (relative to the native human αCGRP sequence). For unknown reasons, the conjugate substituting a thioether linkage (Table 4, SEQ ID NO:17) did not benefit from the same rearrangement at positions 24 and 25 (relative to the native human αCGRP sequence), even though the unPEGylated peptide exhibited a more than 4-fold improvement in potency (compare Table 4, SEQ ID NO:8 to SEQ ID NO:9). The conjugation site also could be moved to position 23 (relative to the native human αCGRP sequence), for example, with the double substitution V23C, K24R (Table 4, SEQ ID NO:10 and SEQ ID NO:11). Remarkably, when PEGylated, this conjugate (Table 4, SEQ ID NO:18) was highly potent, exhibiting an $IC_{50}$=0.16 nM in the in vitro cAMP assay. This was nearly 31-fold more potent than the nonPEGylated native sequence CGRP(8-37).

The invention is not limited to the above-exemplified peptide sequence modifications or PEG molecules. For example, efficacious vehicle-peptide conjugates can be achieved at other positions in the hinge region or in either of the $CGRP_1$ receptor binding regions. Further, the introduction of reactive conjugation sites does not rely solely on sequence substitutions with lysine or cysteine residues, but can include insertions between existing residues, or addition of different reactive amino acids. Moreover, since this invention can utilize synthetic peptides, numerous chemical strategies can be employed to achieve vehicle conjugation at preferred sites in the CGRP peptide. Finally, the vehicle itself is not limited to PEG, but may include any of a broad list of biocompatible polymers, polysaccharides, proteins or peptides, as described herein.

TABLE 4

In vitro $CGRP_1$ receptor-mediated cAMP assays (n = 2-4) comparing a variety of PEG-conjugated peptide antagonists. Conjugates vary in the site of PEGylation (e.g., amino acid positions 23, 24 or 25 relative to the native human αCGRP sequence), and their respective linkage chemistries (amine, amide or thioether). Modifications to the native human αCGRP(8-37) peptide antagonist sequence are shown in boldface. Site-specific PEG conjugation is indicated at the underlined residue.

| SEQ ID NO: | 20 k PEG Linkage | Sequence | $IC_{50}$ (nM) |
|---|---|---|---|
| 1 | None | VTHRLAGLLSRSGGVVKNNFVPTNVGSKAF-NH$_2$ | 4.94 |
| 5 | None | Ac-WVTHRLAGLLSRSGGVVKNNFVPTDVGPFAF-NH$_2$ | 0.14 |
| 12 | Amine | Ac-WVTHRLAGLLSRSGGVV<u>K</u>NNFVPTDVGPFAF-NH$_2$ | 3.05 |
| 13 | Amide | Ac-WVTHRLAGLLSRSGGVV<u>K</u>NNFVPTDVGPFAF-NH$_2$ | 2.15 |
| 9 | None | Ac-WVTHRLAGLLSRSGGVVCNNFVPTDVGPFAF-NH$_2$ | 2.15 |
| 14 | Thioether | Ac-WVTHRLAGLLSRSGGVV<u>C</u>NNFVPTDVGPFAF-NH$_2$ | 2.20 |
| 7 | None | Ac-WVTHRLAGLLSRSGGVVRKNFVPTDVGPFAF-NH$_2$ | 0.13 |
| 15 | Amine | Ac-WVTHRLAGLLSRSGGVVR<u>K</u>NFVPTDVGPFAF-NH$_2$ | 0.42 |
| 16 | Amide | Ac-WVTHRLAGLLSRSGGVVR<u>K</u>NFVPTDVGPFAF-NH$_2$ | 0.39 |
| 8 | None | Ac-WVTHRLAGLLSRSGGVVRCNFVPTDVGPFAF-NH$_2$ | 0.50 |
| 17 | Thioether | Ac-WVTHRLAGLLSRSGGVVR<u>C</u>NFVPTDVGPFAF-NH$_2$ | 1.90 |
| 10 | None | Ac-WVTHRLAGLLSRSGGVCRNNFVPTDVGPFAF-NH$_2$ | 0.36 |
| 18 | Thioether | Ac-WVTHRLAGLLSRSGGV<u>C</u>RNNFVPTDVGPFAF-NH$_2$ | 0.16 |
| 11 | None | Ac-WVTHRLAGLLSRSGGVKRNNFVPTDVGPFAF-NH$_2$ | 0.51 |
| 19 | Amine | Ac-WVTHRLAGLLSRSGGV<u>K</u>RNNFVPTDVGPFAF-NH$_2$ | 0.98 |
| 3 | None | CGGGGGGGVTHRLAGLLSRSGGVVKNNFVPTDVGPFAF-NH$_2$ | 0.72 |
| 20 | Thioether | <u>C</u>GGGGGGGVTHRLAGLLSRSGGVVKNNFVPTDVGPFAF-NH$_2$ | 138. |

Example 3

Increased Circulating Half-Lives In Vivo Measured by ELISA

Typically, injected peptides are rapidly metabolized, with circulating half-lives on the order of minutes. (Felix, A., Site-specific Poly(ethylene glycol)ylation of peptides, ACS Symposium Series 680 (Polyethylene glycol), 218-238 (1997)). In the present example, we demonstrate that peptides of the invention overcome this obstacle by providing an extended pharmacokinetic profile in vivo.

In one experiment C57 Black 6 mice (n=5 per timepoint) were each dosed subcutaneously with 5 mg/kg of PEG-CGRP (Table 4, SEQ ID NO: 15) at t=0. Each group was then sacrificed at t=4, 24, 48 and 72 hrs and the plasma was assayed by sandwich ELISA to determine CGRP peptide concentration.

The ELISA system employed utilizes antibodies specific for each of the respective ends of the peptide and accurately quantifies functional CGRP peptide. Briefly, microplate wells were coated with the capture reagent anti-C-CGRP polyclonal antibody (pAb; 0.050 μg/well incubation overnight at 4° C.) raised against the C-terminal domain of a modified CGRP peptide α-CGGGGGGGPTDVGPFAF-NH$_2$ (SEQ ID NO:45; designated "cgCGRP27"). The wells were washed and blocked with I-Block buffer (Tropix, Bedford, Mass.). Samples were pretreated in I-Block buffer 1:10 to achieve 5% or 10% final (rodent or human) plasma concentration; sample dilutions were carried out in I-Block, 5% or 10% matching plasma. Diluted samples (50 μl/well) were added to anti-C-CGRP coated wells and were incubated at room temperature for 2 hours with shaking, after which the wells were washed with I-Block buffer (4° C.) to remove unbound CGRP peptide. Horseradish peroxidase (HRP) labeled α-N-CGRP pAb conjugate, specific for the N-terminal domain of CGRP α-CGGGGGGVTHRLAGLLSRSGGVVKNN-FVPTDVGPFAF-NH$_2$ (SEQ ID NO:46) was diluted in I-Block buffer and added to the wells and incubated for 1 hour (at room temperature with shaking), for detection of captured CGRP peptide. After another washing step, Pico (Bio FX Laboratories) substrate was added to the wells creating a luminescent signal proportional to the amount of CGRP peptide bound by the capture reagent in the initial step. The intensity of luminescence was measured with a luminometer. Standard (STD) and quality control (QC) samples were made by spiking cgCGRP-27 into 100% matching plasma, were loaded into wells after pretreatment and in I-Block buffer 1:10 and further dilutions in I-Block buffer, and were otherwise assayed in accordance with the ELISA method described above.

Table 5 shows results demonstrating an increase in pharmacokinetic half-life achieved by vehicle-conjugated CGRP peptide antagonists of the present invention. PEG-CGRP (20 kDa PEG; CGRP peptide sequence at Table 4, SEQ ID NO:15) was delivered subcutaneously at 5 mg/kg to C57 Black 6 mice (n=5), and plasma samples were taken at time points (t=4, 24, 48 and 72 hours). ELISA was used as described herein above to detect intact CGRP peptide, which persisted in vivo for at least 72 hours.

TABLE 5

In vivo stability of PEG-CGRP peptide (20 kDa PEG; CGRP peptide SEQ ID NO: 15, 5 mg/kg) in C57 Black 6 mice (n = 5) following subcutaneous injection.

| | Time (h) | | | |
|---|---|---|---|---|
| | 4 | 24 | 48 | 72 |
| Concn CGRP peptide (ng/ml) | 880 ± 248 | 33 ± 12 | 7 ± 1 | 1 ± 0 |

Concentration values are mean ± SD.

Example 4

Increased Stability of a Vehicle-Conjugated CGRP Peptide Antagonist in Plasma

Although the remarkable increase in the circulating half-life of a PEG-CGRP peptide antagonist demonstrated in Example 3 is most likely due to decreased renal clearance, it is also possible that the PEG-conjugated peptide enjoys some additional protection from proteolytic degradation. To test this hypothesis, in vitro experiments were performed comparing the stability of a PEG-CGRP peptide antagonist (SEQ ID NO:15) to its non-PEGylated parent peptide (i.e., SEQ ID NO:7) in 5% mouse plasma at room temperature. Peptide samples at 2 mg/ml in PBS were spiked with 5% mouse plasma and analyzed by sandwich ELISA (as described in Example 3 herein above) over 48 hours at room temperature. Peptide integrity was determined by sandwich ELISA requiring intact peptide termini. Quality controls were made at t=0, 4, 24, and 48 hours before preparation of the standard curve and quantification; recovery should be 100% if no analyte is lost during analysis; a recovery of 80-90% at t=0 was observed and represents the assay variability. The PEG-peptide half-life was more than 9-fold longer than the non-PEGylated parent peptide (see, Table 6). Clearly, conjugation with vehicle conferred additional stability to the CGRP peptide in the presence of plasma.

TABLE 6

In vitro recovery of unconjugated CGRP peptide (SEQ ID NO: 7) compared to vehicle-conjugated CGRP peptide (SEQ ID NO: 15) in 5% mouse plasma.

| | Time (h) | | | |
|---|---|---|---|---|
| | 0 | 4 | 24 | 48 |
| SEQ ID NO: 7 | 112.1 ± 1.8 | 46.1 ± 60.1 | 2.509 ± 0.573 | 1.812 ± 0.754 |
| SEQ ID NO: 15 | 82.84 ± 8.68 | 93.93 ± 15.52 | 55.83 ± 15.77 | 26.21 ± 3.32 |

Values are mean (%) ± SD.

Example 5

Figures 1, 2:
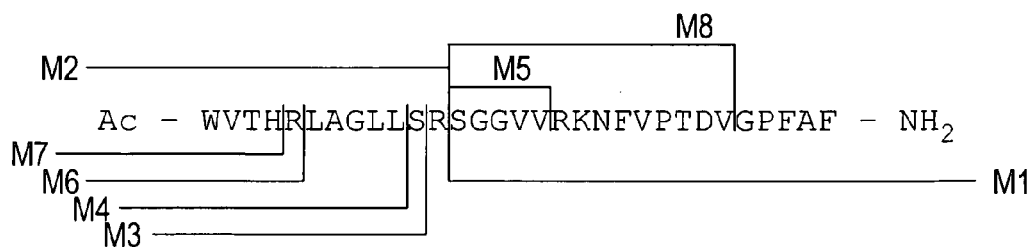
FIG. 1 shows the native amino acid sequence of full-length human αCGRP (SEQ ID NO:43) with functional domains and secondary structural elements defined. Shaded residues (R11, R18, T30, V32, S34 and F35-amide) have been implicated by the prior art in receptor binding, with modifications at those positions typically having a positive or negative effect on binding to $CGRP_1$. Source: Conner et al., Interaction of calcitonin-gene-related peptide with its receptors, Biochemical Society Transactions, 30(Part 4): 451-454 (2002).
FIG. 2 illustrates the proteolytic cleavage fragments M1-M8 of SEQ ID NO:7 after incubation in 10% rat plasma for 1 hour at room temperature, detected by LC/MS with the major cleavages occurring after L16, S17, and R18 relative to the native human αCGRP sequence.

Substitutions in CGRP Peptide Sequence to Protect from Proteolysis while Preserving Potency Despite the significant protection afforded CGRP by this invention from proteolytic degradation (Example 4) and renal clearance in vivo (Example 3), select fragments of CGRP were still detected in these experiments. To determine the most labile proteolytic cleavage sites CGRP analog SEQ ID NO:7 (Table 3) was spiked into rat plasma at 2.5 mg/ml and incubated for 1 hour at room temperature. The samples were then diluted 10-fold with water and analyzed by LC/MS. CGRP fragments designated M1-M8 (FIG. 2) were detected, with the major cleavages occurring after R11, L16, S17 and R18 (relative to the native human αCGRP sequence). Combined with literature data (e.g., LeGreves et al., Regulatory Peptides, 25:277-286 (1989); Katayama et al., Peptides, 12:563-567 (1991); Tam and Caughey, Degradation of airway neuropeptides by human lung tryptase, Am. J. Resp. Cell Mol. Biol., 3(1):27-32 (1990)), for proteolytic sites of human αCGRP, R11, L15, L16, S17 and R18 are potential sites for major proteolytic liabilities. Unfortunately, the R11, L16 and R18 residues have been previously identified as important for receptor binding and antagonist activity. A. C. Conner et al., Interaction of Calcitonin-Gene-Related Peptide with its Receptors, Biochemical Society Transactions 30:451-455 (2002); Howitt et al., British Journal of Pharmacology, 138: 325-332 (2003)). Nevertheless, we designed several protease resistant analogs with modifications at R11, L16 and/or R18 with the hope of preserving sufficient activity for efficacious antagonism of the CGRP$_1$ receptor.

Substitutions for arginine were selected based on preservation of charge and hydrogen bonding potential. The analogs were synthesized as either single or double substitutions with homoarginine, D-arginine, citrulline, alanine, or glutamine at positions 11 and/or 18 (relative to the native human αCGRP sequence). Each analog was tested before and after PEGylation for in vitro activity in the cAMP assay as described in Example 1.

Table 7 shows results of in vitro CGRP$_1$ receptor-mediated cAMP assays comparing a variety CGRP peptide analogs substituted at positions R11 and/or R18 (relative to the native human αCGRP sequence). Also shown are the effects of PEGylation and the linkage type on CGRP$_1$ receptor antagonist activity as measured by the cAMP assay. Modifications to the native human αCGRP(8-37) antagonist sequence are shown in boldface. Site-specific PEGylation is indicated at the underlined residue. In general, non-PEGylated single-substitution homoarginine analogs (Table 7, SEQ ID NO:21 and SEQ ID NO:23) were well tolerated, retaining their CGRP$_1$ receptor antagonist activity when PEGylated with 20 kDa PEG via an amine linkage (Table 7, SEQ ID NO:22 and SEQ ID NO:24). However, a non-PEGylated double homoarginine mutant (Table 7, SEQ ID NO:25) showed about 5-fold reduced antagonist activity relative to either of the non-PEGylated peptides with single substitutions (i.e., SEQ ID NO:21 and SEQ ID NO:23). When this double substitution peptide was PEGylated (Table 7, SEQ ID NO:26), the antagonist activity returned to the levels of the two peptides with single substitutions.

Citrulline-substituted analogs showed a pattern similar to homoarginine-substituted analogs, wherein the single substitutions at either positions II or 18 (Table 7, SEQ ID NO:27 and SEQ ID NO:29) were well tolerated, the double substitution (Table 7. SEQ ID NO:31) exhibiting only about 3-fold less potent CGRP$_1$ receptor antagonism than either single substitution. However, all the citrulline-substituted analogs suffered some relatively minor loss of in vitro antagonist activity when PEGylated (Table 7, SEQ ID NO:28, SEQ ID NO:30 and SEQ ID NO:32), with the R18Cit single-substitution analog exhibiting the best IC$_{50}$ of these.

Initially, substitutions with natural amino acids, alanine, glutamine and D-arginine were tested only as single-substitutions at position R18 (relative to the native human αCGRP sequence) and in the context of a cysteine PEGylation site at position 25 (relative to the native human αCGRP sequence; Table 4, SEQ ID NO:8). While alanine at this position (Table 7, SEQ ID NO:33) was not well tolerated as to in vitro antagonist activity measured by cAMP assay, it was surprising to discover that glutamine (Table 7, SEQ ID NO:35) and D-arginine (SEQ ID NO:41) were both well tolerated as to antagonist activity measured by CGRP$_1$ receptor-mediated cAMP assay. Unfortunately, when PEGylated, both the single-substitution glutamine (Table 7, SEQ ID NO:36) and D-arginine (Table 7, SEQ ID NO:42) analogs suffered a large loss in in vitro antagonist activity, greater than 12-fold and greater than 32-fold, respectively.

Noting that in the context of an amine linkage, the PEGylated homoarginine-substituted (Table 7, SEQ ID NO:26) and citrulline-substituted (Table 4, SEQ ID NO:32) analogs seemed to preserve greater potency, a pair of single- (Table 7, SEQ ID NO:37) and double-glutamine (Table 7, SEQ ID NO:39) substitution analogs were prepared with lysine at position 25 (relative to the native human αCGRP sequence) instead of cysteine. Remarkably, when the single-substitution glutamine analog (Table 7, SEQ ID NO:38) was PEGylated in this context, using an amine linkage, the resulting conjugate was more than 42-fold more potent than the equivalent CGRP peptide analog that was PEGylated with a thioether linkage (Table 7, SEQ ID NO:36). Similarly, the double-substituted glutamine analog PEGylated through an amine linkage (Table 7, SEQ ID NO:40) also showed reasonably good in vitro potency. These results reinforce our previous observations that PEGylation through an amine linkage preserves the largest percentage of the analog's potency. Amine coupling of PEG to glutamine-substituted analogs (Table 7, SEQ ID NO:38 and SEQ ID NO:40) resulted in potent vehicle-conjugated CGRP peptide antagonists.

TABLE 7

In vitro CGRP$_1$ receptor-mediated cAMP assays comparing a variety of stability analogs substituted at positions R11 and/or R18 (relative to the native human αCGRP sequence). Also shown are the effects of PEGylation and the linkage type on antagonist activity. Modifications to the native human αCGRP(8-37) antagonist sequence are shown in boldface. Site-specific PEGylation is indicated at the underlined residues.

| SEQ ID NO: | 20 kDa PEG Linkage | Sequence | IC$_{50}$ (nM) |
|---|---|---|---|
| 21 | None | Ac-WVTH(hR)LAGLLSRSGGVVRKNFVPTDVGPFAF-NH$_2$ | 0.44 |
| 22 | Amine | Ac-WVTH(hR)LAGLLSRSGGVVR<u>K</u>NFVPTDVGPFAF-NH$_2$ | 0.36 |
| 23 | None | Ac-WVTHRLAGLLS(hR)SGGVVRKNFVPTDVGPFAF-NH$_2$ | 0.57 |
| 24 | Amine | Ac-WVTHRLAGLLS(hR)SGGVVR<u>K</u>NFVPTDVGPFAF-NH$_2$ | 0.33 |
| 25 | None | Ac-WVTH(hR)LAGLLS(hR)SGGVVRKNFVPTDVGPFAF-NH$_2$ | 2.1 |
| 26 | Amine | Ac-WVTH(hR)LAGLLS(hR)SGGVVR<u>K</u>NFVPTDVGPFAF-NH$_2$ | 0.37 |
| 27 | None | Ac-WVTH(Cit)LAGLLSRSGGVVRKNFVPTDVGPFAF-NH$_2$ | 0.57 |

TABLE 7-continued

In vitro CGRP₁ receptor-mediated cAMP assays comparing a variety of stability analogs substituted at positions R11 and/or R18 (relative to the native human αCGRP sequence). Also shown are the effects of PEGylation and the linkage type on antagonist activity. Modifications to the native human αCGRP(8-37) antagonist sequence are shown in boldface. Site-specific PEGylation is indicated at the underlined residues.

| SEQ ID NO: | 20 k Da PEG Linkage | Sequence | $IC_{50}$ (nM) |
|---|---|---|---|
| 28 | Amine | Ac-WVTH(Cit)LAGLLSRSGGVVRKNFVPTDVGPFAF-NH₂ | 2.08 |
| 29 | None | Ac-WVTHRLAGLLS(Cit)SGGVVRKNFVPTDVGPFAF-NH₂ | 0.58 |
| 30 | Amine | Ac-WVTHRLAGLLS(Cit)SGGVVRKNFVPTDVGPFAF-NH₂ | 0.96 |
| 31 | None | Ac-WVTH(Cit)LAGLLS(Cit)SGGVVRKNFVPTDVGPFAF-NH₂ | 1.8 |
| 32 | Amine | Ac-WVTH(Cit)LAGLLS(Cit)SGGVVRKNFVPTDVGPFAF-NH₂ | 3.74 |
| 33 | None | Ac-WVTHRLAGLLSASGGVVRCNFVPTDVGPFAF-NH₂ | 2.75 |
| 34 | Thioether | Ac-WVTHRLAGLLSASGGVVRCNFVPTDVGPFAF-NH₂ | 6.2 |
| 35 | None | Ac-WVTHRLAGLLSQSGGVVRCNFVPTDVGPFAF-NH₂ | 0.37 |
| 36 | Thioether | Ac-WVTHRLAGLLSQSGGVVRCNFVPTDVGPFAF-NH₂ | 4.69 |
| 37 | None | Ac-WVTHRLAGLLSQSGGVVRKNFVPTDVGPFAF-NH₂ | 0.56 |
| 38 | Amine | Ac-WVTHRLAGLLSQSGGVVRKNFVPTDVGPFAF-NH₂ | 0.11 |
| 39 | None | Ac-WVTHQLAGLLSQSGGVVRKNFVPTDVGPFAF-NH₂ | 0.53 |
| 40 | Amine | Ac-WVTHQLAGLLSQSGGVVRKNFVPTDVGPFAF-NH₂ | 1.33 |
| 41 | None | Ac-WVTHRLAGLLSrSGGVVRCNFVPTDVGPFAF-NH₂ | 0.59 |
| 42 | Thioether | Ac-WVTHRLAGLLSrSGGVVRCNFVPTDVGPFAF-NH₂ | 19.42 |

Example 6

In Vitro Stability of CGRP Peptide Antagonists in Mammalian Plasma

In Example 5, several potent CGRP analogs were identified with mutations designed to resist proteolysis at positions R11 and R18 (relative to the native human αCGRP sequence). Although somewhat less active in the in vitro cAMP assay (but with $IC_{50}$ still less than 10 nM), these CGRP analogs could prove even more efficacious in vivo, if relieved of the proteolytic liability associated with the native R11 and R18 residues.

Consequently, the stability of select, non-PEGylated analogs was ev

ID NO:39) were very similar in their stability profiles, with 10% remaining at about 4 hours and 50% at about 1 hour.

These two experiments (Table 8 and Table 9) demonstrated the beneficial effects of adding proteolysis-resistant substitutions in positions R11 and R18 of CGRP peptide antagonists. Even though the peptide degradation profiles were faster in human plasma Table 9) than in rat plasma (Table 8), the relative stability ranking was the same in plasma from either species: SEQ ID NO:7 (R11/R18)<SEQ ID NO:37 (R11R18Q)<SEQ ID NO:25 (R11hR/R18hR)<SEQ ID NO:31 (R11Cit/R18Cit)=SEQ ID NO:39 (R11Q/R18Q).

In some additional experiments, CGRP peptides were incubated at room temperature in 100% plasma (human or monkey) at initial concentration of 10 µg/ml. Briefly, at time points of 0 hour and 4 hour, 100 µl-plasma samples were taken, followed immediately by solid phase extraction. Extracted samples were collected for LC-MS/MS analysis. LC-MS/MS was carried out in a Thermo Finnigan LCQ ion trap equipped with Agilent 1100 LC system. High performance liquid chromatographic separation was carried out on a C18 reverse phase column. Data dependent tandem mass spectrometric detection was used for peptide sequencing. A comparison of in vitro metabolic identification of CGRP peptide SEQ ID NO:658, the non-PEGylated "parent" peptide of PEGylated CGRP peptide Seq ID: No: 172 (FIG. 9) and CGRP peptide SEQ ID NO:144, the non-PEGylated "parent" peptide of PEGylated CGRP peptide Seq ID No:173 (FIG. 10) in 100% human plasma was made. The results in FIG. 9 and FIG. 10 show that the two CGRP analogs (R11Cit/R18Cit/R24hR/P34Oic, [SEQ ID NO:658], R11Cit/R18Cit/R$^{24}$hR/F35Nal, [SEQ ID NO:173]) were relatively stable after four hours incubation in 100% human plasma. The major degradation product for peptide SEQ ID NO:658 was fragment W7-hR24. There were more cleavage sites for CGRP peptide SEQ ID NO:173; the proteolytic degradation products were fragments W7-P34, W7-hR24 and W7-N26.

FIG. 11 shows results of in vitro metabolic identification of CGRP peptide SEQ ID NO:658, the unconjugated "parent" peptide of PEGylated CGRP peptide Seq ID No:172 in 100% Cynomolgus monkey plasma. The results indicate that there were differences in in vitro stability in human and monkey plasma. The major degradation product for CGRP peptide SEQ ID NO:658 was fragment W7-K25 in monkey plasma instead of fragment W7-hR24 in human plasma. (Also, see Example 7 herein below for comparison with in vivo metabolic identification.)

TABLE 8

In vitro stability study of CGRP peptides in 10% rat plasma. Samples of each CGRP peptide analog at 100 ng/ml were exposed to 10% rat plasma at room temperature and were analyzed by LC-MS/MS to determine % remaining peptide at each time point.

| SEQ ID NO | % Remaining | | | | | | | |
|---|---|---|---|---|---|---|---|---|
| | 0 h | 0.5 h | 1 h | 2 h | 3 h | 4 h | 5 h | 6 h |
| 37 | 100.0 | 62.7 | 39.5 | 10.5 | 4.7 | 2.5 | 1.3 | 0.7 |
| 39 | 100.0 | 83.8 | 66.2 | 29.9 | 20.4 | 11.8 | 6.4 | 4.0 |
| 7 | 100.0 | 55.4 | 34.5 | 8.0 | 5.2 | 1.4 | 1.7 | 0.6 |
| 31 | 100.0 | 82.3 | 59.0 | 26.1 | 18.5 | 10.1 | 5.2 | 3.3 |
| 25 | 100.0 | 76.9 | 58.1 | 27.5 | 21.3 | 16.3 | 11.0 | 7.1 |

TABLE 9

In vitro stability study of CGRP peptides in 10% human plasma. Samples of each CGRP peptide analog at 100 ng/ml were exposed to 10% human plasma at room temperature and was analyzed by LC-MS/MS to determine % remaining peptide at each time point.

| Peptide | % Remaining | | | | | | | | |
|---|---|---|---|---|---|---|---|---|---|
| | 0 h | 0.17 h | 0.5 h | 1 h | 2 h | 3 h | 4 h | 5 h | 6 h |
| SEQ ID NO: 37 | 100.0 | 59.0 | 20.6 | 10.0 | 2.3 | 1.3 | 0.7 | 0.7 | 0.0 |
| SEQ ID NO: 39 | 100.0 | 74.2 | 54.0 | 50.2 | 36.7 | 15.8 | 11.3 | 6.3 | 5.2 |
| SEQ ID NO: 7 | 100.0 | 60.3 | 13.8 | 4.9 | 0.0 | 0.0 | 0.0 | 0.0 | 0.0 |
| SEQ ID NO: 31 | 100.0 | 73.0 | 52.8 | 44.0 | 34.9 | 15.3 | 11.8 | 6.1 | 5.9 |
| SEQ ID NO: 25 | 100.0 | 88.3 | 47.3 | 28.7 | 11.0 | 5.4 | 3.1 | 3.6 | 2.8 |

Example 7

Pharmacokinetic (PK) Studies

Rat pharmacokinetic studies. The results of pharmacokinetic (PK) studies of some PEG-conjugated CGRP peptide antagonists, conducted in male Sprague-Dawley rats, are shown in Table 10. There were three rats per group (n=3), each weighing 250-325 g. Each group received either a 2 mg/kg intravenous or subcutaneous discrete administration. The approximate dose volume was 0.3 mL per rat. Approximately 0.25 mL of whole blood was taken per time point at the following post-dose collection times for the intravenous groups (in hours): 0.083, 0.25, 0.5, 1, 2, 4, 6, 8, 24, 48, 72, 96 and the following time points for the subcutaneous groups (in hours): 0.25, 0.5, 1, 2, 4, 6, 8, 24, 48, 72, 96. Whole blood samples were collected in microtainer vials containing EDTA as anticoagulant and were kept on wet ice until processed for plasma. The plasma was obtained by centrifuging the whole blood for approximately 5 min at 11,500 rpm. Plasma was transferred to new tubes and stored frozen at approximately −70° C. until quantitative analysis. The assay for the quantification of the vehicle-conjugated CGRP peptides was conducted in accordance with the ELISA method described in Example 3 above, using rat plasma. The individual sample concentrations for each time point were averaged (n=3) within a given dose group using Excel 2000 software. The averaged plasma concentration-time data were analyzed by noncompartmental methods using WinNonlin v.3.3 software. Nominal sample times were used in the pharmacokinetic analysis. The area under the concentration-time curve was calculated using the linear/log trapezoidal method to determine exposure.

The results in Table 10 demonstrate an enhanced overall pharmacokinetic profile for the vehicle-conjugated CGRP peptide antagonist having SEQ ID NO:32 (including R11Cit, R18Cit substitutions in its amino acid sequence relative to the native human αCGRP sequence), compared to a vehicle-conjugated CGRP peptide antagonist having SEQ ID NO:15, while the results for SEQ ID NO:26 and SEQ ID NO:40 were more similar to those for SEQ ID NO:15. Following intravenous administration, the mean residence time (MRT) was 4 times longer for the vehicle-conjugated CGRP peptide antagonist having SEQ ID NO:32, compared to the vehicle-conjugated CGRP peptide antagonist having SEQ ID NO:15. Following subcutaneous administration, exposure (AUC) was increased by about 15-fold, resulting in the enhanced bioavailablity (F %) of 47% versus 12%. Thus, the R11Cit, R18Cit substitutions provided the best overall PK profile of the four peptides tested in vivo.

the cephalic vein of three male Cynomolgus monkeys (*Macaca fascicularis*) for blood sampling during the study. For the intravenous (iv) leg of the study, a catheter was also placed in a saphenous vein for infusion of test compound. On each study day, the monkeys were placed in restraining chairs for the first 4 h of the study to facilitate drug administration and blood sampling. For administration of antagonist, each monkey received solubilized peptide (dose and SEQ ID listed in Table 11 below) either as a 30-min intravenous infusion (4 mL/kg/h) or as a single subcutaneous bolus (approx. 1.0 mL/animal). Blood samples were collected from each study animal at various times during and after drug administration, plasma samples (100 μL) were isolated by centrifugation and stored at −70° C. until analysis. For monkeys receiving intravenous infusion, such a sample was also taken at 20 min during the infusion.

As shown in Table 11, SEQ ID NO: 172 peptide displayed low plasma clearance, a small volume of distribution and a mean residence time (MRT) of 2.5 h. Exposure following subcutaneous administration of both PEG-conjugated CGRP peptides evaluated was several fold higher in non-human primates compared to rats (Table 10). The better exposure appears to be due to better absorption following subcutaneous

TABLE 10

Results of pharmacokinetic of vehicle-conjugated CGRP peptide antagonists conducted in male Sprague-Dawley rats.

| | | | SC | | | | |
|---|---|---|---|---|---|---|---|
| Peptide | $T_{max}$ (h) | $C_{max}$ (ng/mL) | $t_{1/2}$ (h) | $AUC_{0-t}$ (ng·h/ml) | $AUC_{0-inf}$ (ng·h/ml) | CL/F (mL/h/kg) | F % |
| SEQ ID NO: 15 | 2.00 | 137 | 22.37 | 1264 | 1542 | 1257 | 12% |
| SEQ ID NO: 26 | 2.00 | 143 | 26.17 | 1188 | 1204 | 1660 | 5% |
| SEQ ID NO: 32 | 4.00 | 1879 | 29.98 | 18933 | 19046 | 105 | 47% |
| SEQ ID NO: 40 | 4.00 | 121 | 27.15 | 1212 | 1223 | 1634 | 11% |
| SEQ ID NO: 172 | 4.67 | 662 | ND | 4349 | 4375 | 647 | 14% |
| SEQ ID NO: 173 | 4.00 | 643 | ND | 4385 | 4396 | 461 | 5% |

| | | IV | | | | |
|---|---|---|---|---|---|---|
| Peptide | $t_{1/2}$ (h) | $AUC_{0-t}$ (ng·h/ml) | $AUC_{0-inf}$ (ng·h/ml) | CL (mL/h/kg) | Vss (mL/kg) | MRT (h) |
| SEQ ID NO: 15 | 10.60 | 12940 | 12959 | 154 | 174 | 1.10 |
| SEQ ID NO: 26 | 7.39 | 24546 | 24555 | 81 | 83 | 1.01 |
| SEQ ID NO: 32 | 42.78 | 40250 | 40431 | 49 | 204 | 4.12 |
| SEQ ID NO: 40 | 32.57 | 10651 | 10666 | 187 | 496 | 2.63 |
| SEQ ID NO: 172 | ND | 31494 | 31543 | 64 | 117 | 1.82 |
| SEQ ID NO: 173 | ND | 80440 | 80996 | 27 | 125 | 4.97 |

Injection (dose = 2 mg/kg) was subcutaneous (SC) or intravenous (IV). The vehicle-conjugated CGRP peptide antagonists were dissolved in aqueous solution (10 mM sodium acetate, 5% sorbitol, pH 4.0). All values represent the mean, n = 3. Listed CGRP peptide sequences are described in detail at Tables 2B, 4, and 7.

Monkey pharmacokinetic studies. Table 11 shows the results of pharmacokinetic studies of some PEG-conjugated, and unconjugated ("naked"), CGRP peptide antagonists of the present invention, conducted in male Cynomolgus monkeys. A complete blood chemistry panel was performed on each monkey prior to each study day to obtain baseline values and ensure hematological recovery. A catheter was placed in administration, lower plasma clearance and smaller volumes of distribution in the non-human primate compared to the rat (see Table 10).

Figure 4:
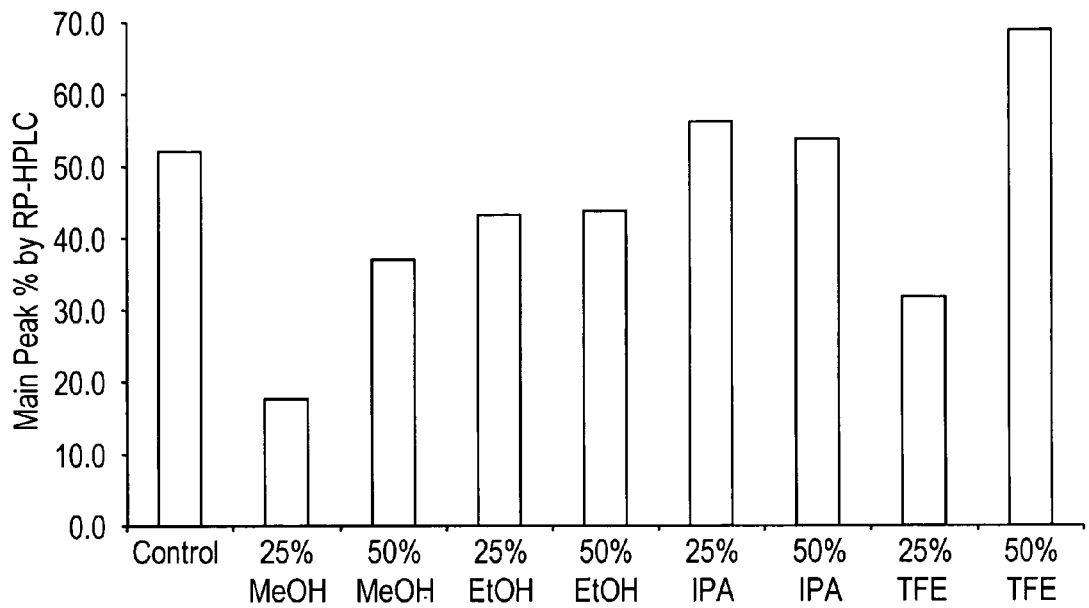
FIG. 4 illustrates the effects of some different alcohol co-solvents on reaction yields for PEGylation of a relatively soluble CGRP peptide (Table 4, SEQ. ID NO: 7).

Metabolic identification of CGRP peptide SEQ ID NO:658 (sequence disclosed in Table 2B) the "parent" peptide of PEGylated CGRP peptide Seq ID: No 172 in monkeys receiving intravenous infusion thereof (sample taken at 20 min during the infusion) was analyzed. Samples were taken as described above. After thawing, each 100-11 plasma sample was extracted by solid phase extraction. Extracted samples were collected for LC-MS/MS analysis. LC-MS/MS was carried out in a Thermo Finnigan LCQ ion trap equipped with Agilent 1100 LC system. High performance liquid chromatographic separation was carried out on a C18 reverse phase column. Data dependent tandem mass spectrometric detection was used for peptide sequencing. The result is shown in FIG. 12, and it indicates that there were also significant differences between in vivo and in vitro stability for the same CGRP peptide SEQ ID NO:658 (in vitro metabolic identification conducted as described for 100% human plasma in Example 6 herein above; FIG. 11). More cleavage sites were observed in the plasma sample from the IV infusion study. The degradation products were fragments W7-T9, T30-A36, W7-N26, T30-F37 and W7-hR24.

by RP-HPLC after 20 hrs. The mono-PEGylated peptide product (Table 4, SEQ ID NO15) was quantitated by integration of the RP-HPLC chromatograms and reported as % Product Peak (FIG. 4). These results demonstrate an inhibitory effect by MeOH and EtOH on PEGylation of this relatively soluble CGRP peptide whereas IPA showed little effect and surprisingly TFE showed both positive and negative effects, depending on concentration.

Next, a comparison was made between the relatively soluble CGRP peptide (sequence disclosed in Table 4, SEQ. ID NO: 7) and a relatively insoluble CGRP peptide (sequence disclosed in Table 7, SEQ ID NO: 31). In this experiment both peptides were PEGylated by reductive alkylation, as described in Example 2, using 20 kDa mPEG-ald in the presence of either 50% IPA or 50% TFE. The progress of each reaction was monitored by RP-HPLC after 20 hrs. The mono-PEGylated peptide product (Table 4, SEQ ID NO15 or Table

TABLE 11

Results of pharmacokinetic of vehicle-conjugated CGRP peptide antagonists conducted in male Cynomolgus monkies.

| | MONKEY SC | | | | | | |
|---|---|---|---|---|---|---|---|
| Peptide | Dose (mg/kg) | Tmax (h) | Cmax (ng/mL) | AUC 0-t (ng · h/ml) | AUC 0-inf (ng · h/ml) | CL/F (mL/h/kg) | F % |
| SEQ ID NO: 172 (Table 2B) | 0.8 | 5.33 | 3597 | 24718 | 24,773 | 28 | 51% |
| SEQ ID NO: 173 (Table 2B) | 0.8 | 5.33 | 1691 | 11842 | 12,195 | 68 | Na |

| | MONKEY IV Ple | | | | | | |
|---|---|---|---|---|---|---|---|
| Peptide | Dose (mg/kg) | T½ (h) | AUC 0-t (ng · h/ml) | AUC 0-inf (ng · h/ml) | CL (mL/h/kg) | Vss (mL/kg) | MRT (h) |
| SEQ ID NO: 172 (Table 2B) | 1.56 | 2.3 | 98,843 | 98,887 | 16 | 41 | 2.54 |
| SEQ ID NO: 658 (naked peptide; Table 2A) | 6.0 | 0.8 | 16,942 | 16,964 | 399 | 174 | 0.42 |

Administration was by intravenous infusion (4 mL/kg/h) or as a single subcutaneous bolus (approx. 1.0 mL/animal). All values represent the mean, n = 3.

Example 8

Co-solvent mediated conjugation of vehicle to CGRP peptide antagonists. Many of the CGRP peptides that were developed to resist proteolysis (see, e.g., Example 4 herein) also proved to be considerably less soluble than their parent peptides (e.g., compared to relatively soluble parent SEQ. ID NO: 7, disclosed in Table 4) in the aqueous conjugation buffers used for coupling vehicle to the peptide (see, Example 2 herein). In an attempt to better solubilize these less soluble peptides during the conjugation reaction, and thereby improve conjugate yields, a variety of alcohol co-solvents were tested in the conjugation reaction.

Figure 5:
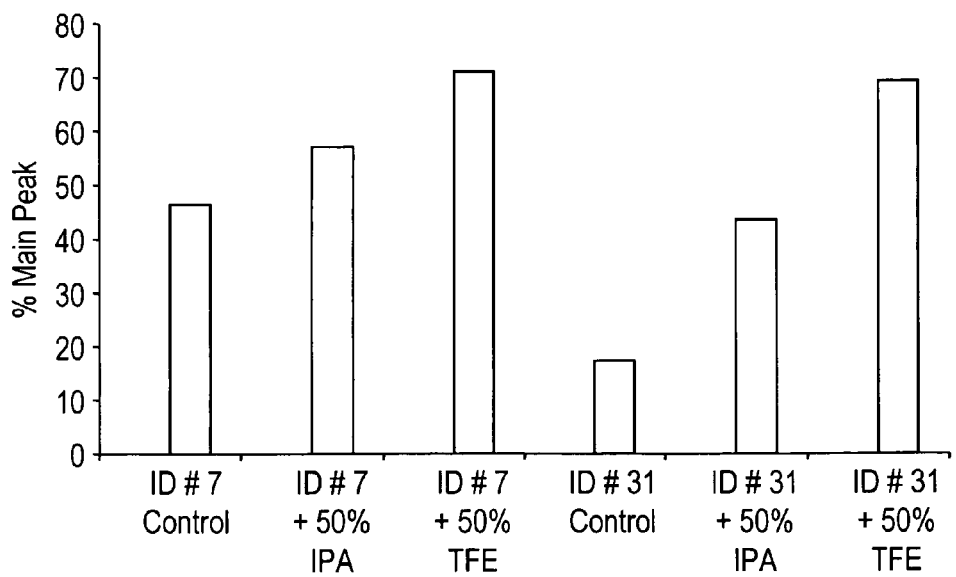
FIG. 5 shows a comparison of the effects of IPA and TFE on the PEGylation efficiency of a relatively soluble CGRP peptide (Table 4, SEQ ID NO:7) and a relatively insoluble CGRP peptide (Table 7, SEQ ID NO: 31).

Briefly, a series of reductive alkylation conjugation reactions using 20 kDa mPEG-ald and the relatively soluble CGRP peptide (Table 4, SEQ. ID NO: 7) were prepared as described in Example 2, with the exception that the alcohols: methanol (MeOH), ethanol (EtOH), isopropanol (IPA) and tri-fluoroethanol (TFE) were each added at either 25% or 50% (v/v) ratio. The progress of each reaction was monitored 7, SEQ ID NO: 32) was quantitated by integration of the RP-HPLC chromatograms and reported as % Product Peak (FIG. 5). These results duplicate the modest improvement in product (Table 4, SEQ ID NO: 15) yield for the more soluble CGRP peptide also observed in FIG. 4. Surprisingly, both co-solvents provided a much more dramatic improvement in PEGylation efficiency for the relatively insoluble CGRP peptide (Table 7, SEQ ID NO: 31), showing increases in product yields of 2.6-fold with IPA and 4.1-fold with TFE.

Over 42 relatively insoluble CGRP peptides have been PEGylated by this method in the presence of 50% TFE with good product yield. At least 34 of these conjugates were produced in excess of 60% product yield (data not shown).

In order to determine the optimal concentrations of co-solvent for PEGylation of different CGRP peptides titration experiments were performed from 30-70% co-solvent using either IPA, TFE or hexafluoro-isopropyl alcohol (HFIPA or HF-i-PA). The PEGylation reactions were prepared as described in Example 2 for reductive alkylation with the three alcohols added at their stated concentrations. The progress of each reaction was monitored by RP-HPLC after 20 hrs. The mono-PEGylated peptide product was quantitated by integration of the RP-HPLC chromatograms and reported as % Product Peak. Unfortunately, HFIPA proved partially immiscible in the aqueous reaction buffer rendering the PEGylation results HFIPA cosolvent difficult to use in the existing process.

Figure 6:
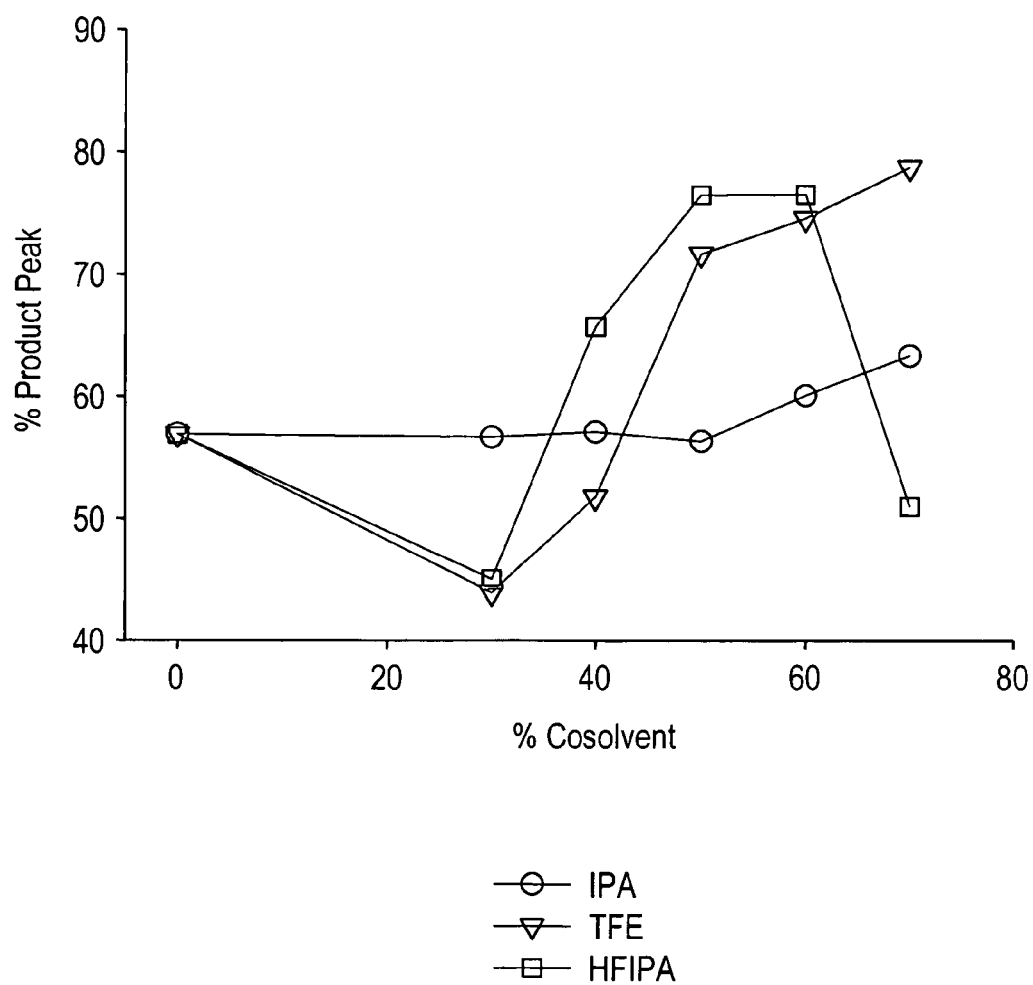

FIG. 6 shows the effects of IPA, TFE, and HFIPA on the relatively soluble CGRP peptide (sequence disclosed in Table 4, SEQ ID NO: 7) examined previously. These data show little effect from IPA until the concentration exceeds 50%. At 70% IPA, a modest 1.1-fold increase in product yield (sequence disclosed in Table 4, SEQ ID NO: 15) was observed. However, 70% TFE shows a more significant increase in product yield of 1.4-fold. HFIPA showed an apparent maximum effect between 50-60%.

FIG. 7 shows the effect of IPA, TFE, and HFIPA on a relatively insoluble CGRP peptide Ac-WVTH[Cit]LAGLLS[Cit]SGGVV[hArg]KNFVPTDVGPFAF-NH$_2$ SEQ ID NO:739 (sequence disclosed in Table 2B) not previously examined. These data show a much more pronounced effect for all three co-solvents. Where IPA produced a maximal effect at about 60% IPA of 1.8-fold increase in product yield for PEGylated CGRP peptide SEQ ID NO:153. With TFE, the results were even more dramatic, showing a continued increase in product yield peaking at about 70% TFE and 3.4-fold. HFIPA also induced a significant increase in product yield (~3.2-fold) at 50% cosolvent, but yields rapidly dropped off at higher HFIPA concentrations.

FIG. 8 shows the effect of IPA, TFE, and HFIPA on a relatively insoluble CGRP peptide SEQ ID NO:658 not previously examined. These data show a much more pronounced effect for all three co-solvents. Where IPA produces a maximal effect at about 70% IPA of 3.3-fold increase in product yield of PEGylated CGRP peptide SEQ ID NO:172. With TFE, the maximum yield was achieved at about 70% TFE with 4.0-fold increase. Again, the HFIPA gives a maximal effect of 4.0-fold increased yield at 50% cosolvent, but then yields quickly drop off at higher HFIPA concentrations. Together, these data illustrate a significant and unexpected efficiency benefit to be realized by utilizing co-solvents in PEGylation reactions for CGRP peptides.

Example 9

Laser Doppler Blood Flowmetry Assay

Methods. An automated laser Doppler blood flowmetry device is used (MoorLDI®; Moor Instrument, Devon, UK). The device was turned on prior to the start of experiments and allowed to warm up for 20 minutes. Blood flow data (in FLUX) were read from software records (see below).

For each rat, the experimental procedure was performed within a single day and was each rat was sacrificed on the same day immediately after the experiment was over. On an experiment day, each rat was weighed and administered 1 ml/kg (intramuscular injection in right leg) of an anesthetic cocktail consisting of Ketamine, Xylazine and PBS (5:3:2). Each rat was then placed in its home cage for 15 min to allow the onset of anesthesia, after which, the ventral surface (abdomen) of the body was shaved. A small dot was placed near the center of the abdomen using a marker. The animal was then ready for the experiment.

Approximately 20 min after the injection of the anesthetic cocktail, baseline blood flow readings were collected for each animal. Each rat was placed under the laser Doppler scanning device, matching the laser with the marker dot on the abdomen. Using the device's software package, the device was activated and the surface of the abdomen was scanned for 1 min with the laser. The scan area was 4 cm×4 cm. The software package associated with the device calculates a blood flow flux value with arbitrary units.

After completion of baseline scanning, the rat was removed from the device. The rat then received an injection of CGRP peptide antagonist (PEGylated CGRP peptide or the corresponding unconjugated ["parent"] CGRP peptide) or its vehicle control via intravenous injection through the dorsal penis vein or subcutaneously in the dorsal right flank. After a pre-determined interval, based on pharmacokinetic characteristics of the relevant CGRP peptide antagonist, agonist (human αCGRP; 0.1 μg, 50 μL; interdermal) was injected such that the point of entry of the needle (30 gauge) was remote from the marker dot but the intradermal injection bolus was centered under the dot.

At 10 min post-hαCGRP (agonist) injection, the rat was placed under laser again to scan the abdomen at the 10 min time point. At 30 min post-hαCGRP (agonist) injection, the rat was placed under the laser one last time to scan the abdomen at the 30 min time point. The scanning parameters were the same as those employed at baseline.

Immediately after the scan at 30 min post-hCGRP, a blood sample was collected from each rat through via cardiac puncture using a 21 gauge syringe. Approximately 200 μL of plasma was obtained by immediate centrifugation of 400 μL whole blood at 14000×g for 10 min at 4° C. The plasma samples were submitted for analytical determination of plasma concentration.

Upon completion of all testing and blood sample collection each rat was sacrificed by asphyxiation with $CO_2$.

Statistical analysis. Blood flow flux values collected at the 10 min and 30 min time points post-hCGRP were converted to % change from baseline values using the formula:

$$X = \frac{(\text{post} - hCGRP \text{ flux value}) - \text{baseline flux value}}{\text{baseline flux}} \times 100$$

Typically, data were analyzed in two ways: 1) analysis of variance (ANOVA) followed by Tukey's HSD post hoc tests, and 2) nonlinear least squares regression (sigmoidal dose-response) for determination of antagonist $ID_{50}$ values and confidence intervals when enough data from enough doses were collected to allow a full dose-response analysis. In some cases, plasma $IC_{50}$ values were calculated by performing least squares linear regression on log plasma concentration values (nM) vs. % change in blood flow values calculated for individual rats.

Results and Conclusions. The experimental results are summarized in Table 12 below. In the laser Doppler blood flowmetry experiments, intradermal injection of hCGRP within a small, defined area of abdominal skin produced a 30-40% increase in local blood flow. Systemic injection of several of our CGRP peptide antagonists (either pegylated or non-pegylated analogs; either the i.v. or s.c. route) reduced the effect of hCGRP in a dose-dependent fashion. Thus, this model was able to demonstrate target coverage by our antagonists in vivo in manner that resulted in functional antagonism of an agonist-mediated effect. Differences in in vitro potency against the rat ortholog of the CGRP1 receptor between pegylated and non-pegylated versions of peptide antagonists generally resulted in similar differences in potency in vivo. For example, SEQ ID NO:808 and SEQ ID NO:809 (the PEGylated version of SEQ ID NO:808) showed similar in vitro and in vivo potencies (see Table 12). On the other hand, SEQ ID NO:31 and its pegylated analog SEQ ID NO:791 showed a marked difference in in vitro functional potency against the rat CGRP1 receptor; the in vitro potency of SEQ ID NO:791 was shifted rightward by approximately 9-fold compared with SEQ ID NO:31. This was reflected by an apparently similar rightward shift in potency in vivo.

In summary, the laser Doppler blood flow model demonstrated on-target, functional antagonistic properties of our peptides in vivo. In vivo potencies generally matched in vitro potency against the rat ortholog of the CGRP1 receptor.

TABLE 12

Laser Doppler results

| Compound SEQ ID NO: | in vitro $IC_{50}$ (rat ortholog; nM) | Administration route | Pre-treatment time (before agonist; minutes) | $ID_{50}$ (plus 95% confidence interval) (mg/kg) | Plasma $IC_{50}$ (nM) | Efficacy observed (%) (at highest dose tested) |
|---|---|---|---|---|---|---|
| 809 (Table 2D) | 6.4 | i.v. | 5 | 0.52 (0.2-1.4) | 916 | 100 (3 mg/kg) |
| 809 (Table 2D) | | s.c. | 240 | | | 100 (10 mg/kg) |
| 808 (Table 2D) | 5.4 | i.v. | 5 | 0.39 (0.2-0.8) | | 100 (0.6 mg/kg) |
| 31 (Tables 3A and 7) | 14.8 | i.v. | 5 | | | 100 (5 mg/kg) |
| 791 (Table 2D) | 130.7 | i.v. | 5 | | | 69 (20 mg/kg) |
| 739 (Table 2D) | 8.9 | i.v. | 5 | 0.89 (0.28-2.8) | | 100 (6 mg/kg) |
| 173 (Table 2B) | 49.5 | i.v. | 5 | | | 75.5 (3 mg/kg) |

The foregoing being illustrative but not an exhaustive description of the embodiments of the present invention, the following claims are presented.

SEQUENCE LISTING (1130 sequences)

SEQ ID NO: 1 - protein, 30 aa, Artificial Sequence
  CGRP peptide
  MOD_RES (30)..(30): AMIDATION
VTHRLAGLLSRSGGVVKNNFVPTNVGSKAF

SEQ ID NO: 2 - protein, 38 aa, Artificial Sequence
  CGRP peptide
  MOD_RES (38)..(38): AMIDATION
CGGGGGGGVTHRLAGLLSRSGGVVKNNFVPTNVGSKAF

SEQ ID NO: 3 - protein, 38 aa, Artificial Sequence
  CGRP peptide
  MOD_RES (38)..(38): AMIDATION
CGGGGGGGVTHRLAGLLSRSGGVVKNNFVPTDVGPFAF

SEQ ID NO: 4 - protein, 31 aa, Artificial Sequence
  CGRP peptide
  MOD_RES (31)..(31): AMIDATION
WVTHRLAGLLSRSGGVVKNNFVPTNVGSKAF

SEQ ID NO: 5 - protein, 31 aa, Artificial Sequence
  CGRP peptide
  MOD_RES (1)..(1): ACETYLATION
  MOD_RES (31)..(31): AMIDATION
WVTHRLAGLLSRSGGVVKNNFVPTDVGPFAF

SEQ ID NO: 6 - protein, 30 aa, Artificial Sequence
  CGRP peptide
  MOD_RES (1)..(1): ACETYLATION
  MOD_RES (30)..(30): AMIDATION
VTHRLAGLLSRSGGVVRKNFVPTDVGPFAF

SEQ ID NO: 7 - protein, 31 aa, Artificial Sequence
  CGRP peptide
  MOD_RES (1)..(1): ACETYLATION
  MOD_RES (31)..(31): AMIDATION
WVTHRLAGLLSRSGGVVRKNFVPTDVGPFAF

SEQ ID NO: 8 - protein, 31 aa, Artificial Sequence
  CGRP peptide
  MOD_RES (1)..(1): ACETYLATION
  MOD_RES (31)..(31): AMIDATION
WVTHRLAGLLSRSGGVVRCNFVPTDVGPFAF

SEQ ID NO: 9 - protein, 31 aa, Artificial Sequence
  CGRP peptide
  MOD_RES (1)..(1): ACETYLATION
  MOD_RES (31)..(31): AMIDATION
WVTHRLAGLLSRSGGVVCNNFVPTDVGPFAF

SEQ ID NO: 10 - protein, 31 aa, Artificial Sequence
  CGRP peptide
  MOD_RES (1)..(1): ACETYLATION
  MOD_RES (31)..(31): AMIDATION
WVTHRLAGLLSRSGGVCRNNFVPTDVGPFAF

SEQ ID NO: 11 - protein, 31 aa, Artificial Sequence
  CGRP peptide
  MOD_RES (1)..(1): ACETYLATION
  MOD_RES (31)..(31): AMIDATION
WVTHRLAGLLSRSGGVKRNNFVPTDVGPFAF

SEQ ID NO: 12 - protein, 31 aa, Artificial Sequence; identical to SEQ ID NO: 5
  CGRP peptide
  MOD_RES (1)..(1): ACETYLATION
  MISC_FEATURE (18)..(18): PEGylated
  MOD_RES (31)..(31): AMIDATION

SEQ ID NO: 13 - protein, 31 aa, Artificial Sequence; identical to SEQ ID NO: 5
  CGRP peptide
  MOD_RES (1)..(1): ACETYLATION
  MISC_FEATURE (18)..(18): PEGylated
  MOD_RES (31)..(31): AMIDATION

SEQ ID NO: 14 - protein, 31 aa, Artificial Sequence; identical to SEQ ID NO: 9
  CGRP peptide
  MOD_RES (1)..(1): ACETYLATION
  MISC_FEATURE (18)..(18): PEGylated
  MOD_RES (31)..(31): AMIDATION

SEQ ID NO: 15 - protein, 31 aa, Artificial Sequence; identical to SEQ ID NO: 7
  CGRP peptide
  MOD_RES (1)..(1): ACETYLATION
  MISC_FEATURE (19)..(19): PEGylated
  MOD_RES (31)..(31): AMIDATION

SEQ ID NO: 16 - protein, 31 aa, Artificial Sequence; identical to SEQ ID NO: 7
  CGRP peptide
  MOD_RES (1)..(1): ACETYLATION
  MISC_FEATURE (19)..(19): PEGylated
  MOD_RES (31)..(31): AMIDATION

SEQ ID NO: 17 - protein, 31 aa, Artificial Sequence; identical to SEQ ID NO: 8
  CGRP peptide
  MOD_RES (1)..(1): ACETYLATION
  MISC_FEATURE (19)..(19): PEGylated
  MOD_RES (31)..(31): AMIDATION

SEQ ID NO: 18 - protein, 31 aa, Artificial Sequence; identical to SEQ ID NO: 10
  CGRP peptide
  MOD_RES (1)..(1): ACETYLATION
  MISC_FEATURE (17)..(17): PEGylated
  MOD_RES (31)..(31): AMIDATION

SEQ ID NO: 19 - protein, 31 aa, Artificial Sequence; identical to SEQ ID NO: 11
  CGRP peptide
  MOD_RES (1)..(1): ACETYLATION
  MISC_FEATURE (17)..(17): PEGylated
  MOD_RES (31)..(31): AMIDATION

SEQ ID NO: 20 - protein, 38 aa, Artificial Sequence; identical to SEQ ID NO: 3
  CGRP peptide
  MISC_FEATURE (1)..(1): PEGylated
  MOD_RES (38)..(38): AMIDATION

SEQ ID NO: 21 - protein, 31 aa, Artificial Sequence
  CGRP peptide
  MOD_RES (1)..(1): ACETYLATION
  MISC_FEATURE (5)..(5): xaa=homoarginine
  MOD_RES (31)..(31): AMIDATION
WVTHXLAGLLSRSGGVVRKNFVPTDVGPFAF

SEQ ID NO: 22 - protein, 31 aa, Artificial Sequence; identical to SEQ ID NO: 21
  CGRP peptide
  MOD_RES (1)..(1): ACETYLATION
  MISC_FEATURE (5)..(5): xaa=homoarginine
  MISC_FEATURE (19)..(19): PEGylated
  MOD_RES (31)..(31): AMIDATION

SEQ ID NO: 23 - protein, 31 aa, Artificial Sequence
  CGRP peptide
  MOD_RES (1)..(1): ACETYLATION
  MISC_FEATURE (12)..(12): xaa=homoarginine
  MOD_RES (31)..(31): AMIDATION
WVTHRLAGLLSXSGGVVRKNFVPTDVGPFAF

SEQ ID NO: 24 - protein, 31 aa, Artificial Sequence; identical to SEQ ID NO: 23
  CGRP peptide
  MOD_RES (1)..(1): ACETYLATION
  MISC_FEATURE (12)..(12): xaa=homoarginine
  MISC_FEATURE (19)..(19): PEGylated
  MOD_RES (31)..(31): AMIDATION

SEQ ID NO: 25 - protein, 31 aa, Artificial Sequence
  CGRP peptide
  MOD_RES (1)..(1): ACETYLATION
  MISC_FEATURE (5)..(5): xaa=homoarginine
  MISC_FEATURE (12)..(12): xaa=homoarginine
  MOD_RES (31)..(31): AMIDATION
WVTHXLAGLLSXSGGVVRKNFVPTDVGPFAF

SEQ ID NO: 26 - protein, 31 aa, Artificial Sequence; identical to SEQ ID NO: 25
  CGRP peptide
  MOD_RES (1)..(1): ACETYLATION
  MISC_FEATURE (5)..(5): xaa=homoarginine
  MISC_FEATURE (12)..(12): xaa=homoarginine
  MISC_FEATURE (19)..(19): PEGylated
  MOD_RES (31)..(31): AMIDATION

SEQ ID NO: 27 - protein, 31 aa, Artificial Sequence; identical to SEQ ID NO: 21
  CGRP peptide
  MOD_RES (1)..(1): ACETYLATION
  MISC_FEATURE (5)..(5): xaa=citrulline
  MOD_RES (31)..(31): AMIDATION

SEQ ID NO: 28 - protein, 31 aa, Artificial Sequence; identical to SEQ ID NO: 21
  CGRP peptide
  MOD_RES (1)..(1): ACETYLATION
  MISC_FEATURE (5)..(5): xaa=citrulline
  MISC_FEATURE (19)..(19): PEGylated
  MOD_RES (31)..(31): AMIDATION

SEQ ID NO: 29 - protein, 31 aa, Artificial Sequence; identical to SEQ ID NO: 23
  CGRP peptide
  MOD_RES (1)..(1): ACETYLATION
  MISC_FEATURE (12)..(12): xaa=citrulline
  MOD_RES (31)..(31): AMIDATION

SEQ ID NO: 30 - protein, 31 aa, Artificial Sequence; identical to SEQ ID NO: 23
  CGRP peptide
  MOD_RES (1)..(1): ACETYLATION
  MISC_FEATURE (12)..(12): xaa=citrulline
  MISC_FEATURE (19)..(19): PEGylated
  MOD_RES (31)..(31): AMIDATION

SEQ ID NO: 31 - protein, 31 aa, Artificial Sequence; identical to SEQ ID NO: 25
  CGRP peptide
  MOD_RES (1)..(1): ACETYLATION
  MISC_FEATURE (5)..(5): xaa=citrulline
  MISC_FEATURE (12)..(12): xaa=citrulline
  MOD_RES (31)..(31): AMIDATION

SEQ ID NO: 32 - protein, 31 aa, Artificial Sequence; identical to SEQ ID NO: 25
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (19)..(19): PEGylated
  MOD_RES (31)..(31): AMIDATION

SEQ ID NO: 33 - protein, 31 aa, Artificial Sequence
  CGRP peptide
  MOD_RES (1)..(1): ACETYLATION
  MOD_RES (31)..(31): AMIDATION
WVTHRLAGLLSASGGVVRCNFVPTDVGPFAF

SEQ ID NO: 34 - protein, 31 aa, Artificial Sequence; identical to SEQ ID NO: 33
  CGRP peptide
  MOD_RES (1)..(1): ACETYLATION
  MISC_FEATURE (19)..(19): PEGylated
  MOD_RES (31)..(31): AMIDATION

SEQ ID NO: 35 - protein, 31 aa, Artificial Sequence
  CGRP peptide
  MOD_RES (1)..(1): ACETYLATION
  MOD_RES (31)..(31): AMIDATION
WVTHRLAGLLSQSGGVVRCNFVPTDVGPFAF

SEQ ID NO: 36 - protein, 31 aa, Artificial Sequence; identical to SEQ ID NO: 35
  CGRP peptide
  MOD_RES (1)..(1): ACETYLATION
  MISC_FEATURE (19)..(19): PEGylated
  MOD_RES (31)..(31): AMIDATION

SEQ ID NO: 37 - protein, 31 aa, Artificial Sequence
  CGRP peptide
  MOD_RES (1)..(1): ACETYLATION
  MOD_RES (31)..(31): AMIDATION
WVTHRLAGLLSQSGGVVRKNFVPTDVGPFAF

SEQ ID NO: 38 - protein, 31 aa, Artificial Sequence; identical to SEQ ID NO: 37
  CGRP peptide
  MOD_RES (1)..(1): ACETYLATION
  MISC_FEATURE (19)..(19): PEGylated
  MOD_RES (31)..(31): AMIDATION

SEQ ID NO: 39 - protein, 31 aa, Artificial Sequence
  CGRP peptide
  MOD_RES (1)..(1): ACETYLATION
  MOD_RES (31)..(31): AMIDATION
WVTHQLAGLLSQSGGVVRKNFVPTDVGPFAF

SEQ ID NO: 40 - protein, 31 aa, Artificial Sequence; identical to SEQ ID NO: 39
  CGRP peptide
  MOD_RES (1)..(1): ACETYLATION
  MISC_FEATURE (19)..(19): PEGylated
  MOD_RES (31)..(31): AMIDATION

SEQ ID NO: 41 - protein, 31 aa, Artificial Sequence
  CGRP peptide
  MOD_RES (1)..(1): ACETYLATION
  MISC_FEATURE (12)..(12): xaa=D-arginine
  MOD_RES (31)..(31): AMIDATION
WVTHRLAGLLSXSGGVVRCNFVPTDVGPFAF

SEQ ID NO: 42 - protein, 31 aa, Artificial Sequence; identical to SEQ ID NO: 41
  CGRP peptide
  MOD_RES (1)..(1): ACETYLATION
  MISC_FEATURE (12)..(12): xaa=D-Arginine
  MISC_FEATURE (19)..(19): PEGylated
  MOD_RES (31)..(31): AMIDATION

SEQ ID NO: 43 - protein, 37 aa, Homo sapiens
  MOD_RES (37)..(37): AMIDATION
ACDTATCVTHRLAGLLSRSGGVVKNNFVPTNVGSKAF

SEQ ID NO: 44 - protein, 37 aa, Homo sapiens
ACNTATCVTHRLAGLLSRSGGMVKSNFVPTNVGSKAF

SEQ ID NO: 45 - protein, 17 aa, Artificial Sequence
  cgCGRP antigen
  MOD_RES (17)..(17): AMIDATION
CGGGGGGGPTDVGPFAF

SEQ ID NO: 46 - protein, 37 aa, Artificial Sequence
  cg N-terminal antigen
  MOD_RES (37)..(37): AMIDATION
CGGGGGGVTHRLAGLLSRSGGVVKNNFVPTDVGPFAF

SEQ ID NO: 47 - protein, 30 aa, Artificial Sequence
  CGRP peptide
  MOD_RES (30)..(30): AMIDATION
VTHRLAGLLSRSGGVVKNNFVPTDVGPFAF

SEQ ID NO: 48 - protein, 30 aa, Artificial Sequence
  CGRP peptide
  MOD_RES (30)..(30): AMIDATION
VTHRLAGLLSRSGGVKRNNFVPTDVGPFAF

SEQ ID NO: 49 - protein, 30 aa, Artificial Sequence; identical to SEQ ID NO: 47
  CGRP peptide
  MOD_RES (30)..(30): AMIDATION

SEQ ID NO: 50 - protein, 30 aa, Artificial Sequence; identical to SEQ ID NO: 6
  CGRP peptide
  MOD_RES (30)..(30): AMIDATION

SEQ ID NO: 51 - protein, 30 aa, Artificial Sequence
  CGRP peptide
  MOD_RES (30)..(30): AMIDATION
VTHRLAGLLSRSGGVVRNKFVPTDVGPFAF

SEQ ID NO: 52 - protein, 30 aa, Artificial Sequence
  CGRP peptide
  MOD_RES (30)..(30): AMIDATION
VTHRLAGLLSRSGGVCRNNFVPTDVGPFAF

SEQ ID NO: 53 - protein, 30 aa, Artificial Sequence
  CGRP peptide
  MOD_RES (30)..(30): AMIDATION
VTHRLAGLLSRSGGVVCNNFVPTDVGPFAF

SEQ ID NO: 54 - protein, 30 aa, Artificial Sequence
  CGRP peptide
  MOD_RES (30)..(30): AMIDATION
VTHRLAGLLSRSGGVVRCNFVPTDVGPFAF

SEQ ID NO: 55 - protein, 30 aa, Artificial Sequence
  CGRP peptide
  MOD_RES (30)..(30): AMIDATION
VTHRLAGLLSRSGGVVRNCFVPTDVGPFAF

SEQ ID NO: 56 - protein, 5 aa, Artificial Sequence
  linker sequence
GGGGG

SEQ ID NO: 57 - protein, 7 aa, Artificial Sequence
  linker sequence
GGGGGGG

SEQ ID NO: 58 - protein, 6 aa, Artificial Sequence
  linker sequence
GGGGGK

SEQ ID NO: 59 - protein, 7 aa, Artificial Sequence
  linker sequence
GGGGGKR

SEQ ID NO: 60 - protein, 8 aa, Artificial Sequence
  linker sequence
GGGKGGGG

SEQ ID NO: 61 - protein, 8 aa, Artificial Sequence
  linker sequence
GGGNGSGG

SEQ ID NO: 62 - protein, 8 aa, Artificial Sequence
  linker sequence
GGGCGGGG

SEQ ID NO: 63 - protein, 5 aa, Artificial Sequence
  linker sequence
GPNGG

SEQ ID NO: 64 - protein, 22 aa, Artificial Sequence
  peptidyl linker sequence
GSGSATGGSGSTASSGSGSATH

SEQ ID NO: 65 - protein, 19 aa, Artificial Sequence
  peptidyl linker sequence
AEAAAKEAAAKEAAAKAGG

SEQ ID NO: 66 - protein, 22 aa, Artificial Sequence
  peptidyl linker sequence
HGSGSATGGSGSTASSGSGSAT

SEQ ID NO: 67 - protein, 5 aa, Artificial Sequence
  linker sequence
GGGGS

SEQ ID NO: 68 - protein, 31 aa, Artificial Sequence; identical to SEQ ID NO: 25
  CGRP peptide
  MOD_RES (1)..(1): ACETYLATION
  MISC_FEATURE (5)..(5): xaa = homocitrulline
  MISC_FEATURE (12)..(12): xaa = homocitrulline
  MOD_RES (31)..(31): AMIDATION

SEQ ID NO: 69 - protein, 31 aa, Artificial Sequence; identical to SEQ ID NO: 25
  CGRP peptide
  MOD_RES (1)..(1): ACETYLATION
  MISC_FEATURE (5)..(5): xaa = homolysine
  MISC_FEATURE (12)..(12): xaa = homolysine
  MOD_RES (31)..(31): AMIDATION

SEQ ID NO: 70 - protein, 31 aa, Artificial Sequence; identical to SEQ ID NO: 25
  CGRP peptide
  MOD_RES (1)..(1): ACETYLATION
  MISC_FEATURE (5)..(5): xaa = N-Methylarginine
  MISC_FEATURE (12)..(12): xaa = N-Methylarginine
  MOD_RES (31)..(31): AMIDATION

SEQ ID NO: 71 - protein, 31 aa, Artificial Sequence
  CGRP peptide
  MOD_RES (1)..(1): ACETYLATION
  MISC_FEATURE (5)..(5): xaa=N-Methylarginine
  misc_feature (12)..(12): Xaa can be any naturally occurring amino acid
  MISC_FEATURE (18)..(18): xaa=N-Methylarginine
  MOD_RES (31)..(31): AMIDATION
WVTHXLAGLLSXSGGVVXKNFVPTDVGPFAF

SEQ ID NO: 72 - protein, 31 aa, Artificial Sequence
  CGRP peptide
  MOD_RES (1)..(1): ACETYLATION
  MISC_FEATURE (5)..(5): xaa=citrulline
  MISC_FEATURE (6)..(6): xaa=N-Methylleucine
  MISC_FEATURE (12)..(12): xaa=citrulline
  MOD_RES (31)..(31): AMIDATION
WVTHXXAGLLSXSGGVVRKNFVPTDVGPFAF

SEQ ID NO: 73 - protein, 31 aa, Artificial Sequence
  CGRP peptide
  MOD_RES (1)..(1): ACETYLATION
  MISC_FEATURE (5)..(5): xaa = citrulline
  MISC_FEATURE (6)..(6): xaa = norleucine
  misc_feature (9)..(9): Xaa can be any naturally occurring amino acid
  MISC_FEATURE (10)..(10): xaa = norleucine
  MISC_FEATURE (12)..(12): xaa = citrulline
  MOD_RES (31)..(31): AMIDATION
WVTHXXAGXXSXSGGVVRKNFVPTDVGPFAF

SEQ ID NO: 74 - protein, 31 aa, Artificial Sequence; identical to SEQ ID NO: 73
  CGRP peptide
  MOD_RES (1)..(1): ACETYLATION
  MISC_FEATURE (5)..(5): xaa = citrulline
  MISC_FEATURE (6)..(6): xaa= norvaline
  misc_feature (9)..(9): Xaa can be any naturally occurring amino acid
  MISC_FEATURE (10)..(10): xaa = norvaline
  MISC_FEATURE (12)..(12): xaa = citrulline
  MOD_RES (31)..(31): AMIDATION

SEQ ID NO: 75 - protein, 31 aa, Artificial Sequence
  CGRP peptide
  MOD_RES (1)..(1): ACETYLATION
  MISC_FEATURE (5)..(5): xaa = citrulline
  MISC_FEATURE (12)..(12): xaa = citrulline
  MOD_RES (31)..(31): AMIDATION
WVTHXLAGLLTXSGGVVRKNFVPTDVGPFAF

SEQ ID NO: 76 - protein, 31 aa, Artificial Sequence
  CGRP peptide
  MOD_RES (1)..(1): ACETYLATION
  MISC_FEATURE (4)..(4): xaa = 1,2,3,4-L-Tetrahydroisoquinoline-3-Carboxylic acid
  MISC_FEATURE (5)..(5): xaa = citrulline
  MISC_FEATURE (12)..(12): xaa = citrulline
  MOD_RES (31)..(31): AMIDATION
WVTXXLAGLLSXSGGVVRKNFVPTDVGPFAF

SEQ ID NO: 77 - protein, 31 aa, Artificial Sequence
  CGRP peptide
  MOD_RES (1)..(1): ACETYLATION
  MISC_FEATURE (5)..(5): xaa = citrulline
  MISC_FEATURE (8)..(8): xaa = sarcosine
  MISC_FEATURE (12)..(12): xaa= citrulline
  MOD_RES (31)..(31): AMIDATION
WVTHXLAXLLSXSGGVVRKNFVPTDVGPFAF

SEQ ID NO: 78 - protein, 31 aa, Artificial Sequence
  CGRP peptide
  MOD_RES (1)..(1): ACETYLATION
  MISC_FEATURE (5)..(5): xaa = citrulline
  MISC_FEATURE (6)..(6): xaa = norleucine
  MISC_FEATURE (9)..(10): xaa = norleucine
  MISC_FEATURE (12)..(12): xaa = citrulline
  MISC_FEATURE (18)..(18): xaa = homoarginine
  MISC_FEATURE (27)..(27): xaa = sarcosine
  MOD_RES (31)..(31): AMIDATION
WVTHXXAGXXTXSGGVVXKNFVPTDVXPFAF

SEQ ID NO: 79 - protein, 31 aa, Artificial Sequence; identical to SEQ ID NO: 78
  CGRP peptide
  MOD_RES (1)..(1): ACETYLATION
  MISC_FEATURE (5)..(5): xaa= homocitrulline
  MISC_FEATURE (6)..(6): xaa = norleucine
  MISC_FEATURE (9)..(10): xaa = norleucine
  MISC_FEATURE (12)..(12): xaa = homocitrulline
  MISC_FEATURE (18)..(18): xaa = homoarginine
  MISC_FEATURE (27)..(27): xaa = sarcosine
  MOD_RES (31)..(31): AMIDATION

SEQ ID NO: 80 - protein, 31 aa, Artificial Sequence; identical to SEQ ID NO: 78
  CGRP peptide
  MOD_RES (1)..(1): ACETYLATION
  MISC_FEATURE (5)..(5): xaa = N-methylarginine
  MISC_FEATURE (6)..(6): xaa = norleucine
  MISC_FEATURE (9)..(9): xaa = norleucine
  MISC_FEATURE (10)..(10): xaa = norleucine
  MISC_FEATURE (12)..(12): xaa = N-methylarginine
  MISC_FEATURE (18)..(18): xaa = N-methylarginine
  MISC_FEATURE (27)..(27): xaa = sarcosine
  MOD_RES (31)..(31): AMIDATION

SEQ ID NO: 81 - protein, 31 aa, Artificial Sequence; identical to SEQ ID NO: 78
  CGRP peptide
  MOD_RES (1)..(1): ACETYLATION
  MISC_FEATURE (5)..(5): xaa = N-methylarginine
  MISC_FEATURE (6)..(6): xaa = norvaline
  MISC_FEATURE (9)..(9): xaa = norvaline
  MISC_FEATURE (10)..(10): xaa = norvaline
  MISC_FEATURE (12)..(12): xaa = N-methylarginine
  MISC_FEATURE (18)..(18): xaa = N-methylarginine
  MISC_FEATURE (27)..(27): xaa = sarcosine
  MOD_RES (31)..(31): AMIDATION

SEQ ID NO: 82 - protein, 30 aa, Artificial Sequence
  CGRP peptide
  MISC_FEATURE (4)..(4): xaa=homocitrulline
  MISC_FEATURE (11)..(11): xaa=homocitrulline
  MOD_RES (30)..(30): AMIDATION
VTHXLAGLLSXSGGVVRKNFVPTDVGPFAF

SEQ ID NO: 83 - protein, 30 aa, Artificial Sequence; identical to SEQ ID NO: 82
  CGRP peptide
  MISC_FEATURE (4)..(4): xaa = homolysine
  MISC_FEATURE (11)..(11): xaa = homolysine
  MOD_RES (30)..(30): AMIDATION

SEQ ID NO: 84 - protein, 30 aa, Artificial Sequence; identical to SEQ ID NO: 82
  CGRP peptide
  MISC_FEATURE (4)..(4): xaa = N-Methylarginine
  MISC_FEATURE (11)..(11): xaa = N-Methylarginine
  MOD_RES (30)..(30): AMIDATION

SEQ ID NO: 85 - protein, 30 aa, Artificial Sequence
  CGRP peptide
  MISC_FEATURE (4)..(4): xaa = N-Methylarginine
  MISC_FEATURE (11)..(11): xaa = N-Methylarginine
  MISC_FEATURE (17)..(17): xaa = N-Methylarginine
  MOD_RES (30)..(30): AMIDATION
VTHXLAGLLSXSGGVVXKNFVPTDVGPFAF

SEQ ID NO: 86 - protein, 30 aa, Artificial Sequence
  CGRP peptide
  MISC_FEATURE (4)..(4): xaa = citrulline
  MISC_FEATURE (5)..(5): xaa = N-Methylleucine
  MISC_FEATURE (11)..(11): xaa = citrulline
  MOD_RES (30)..(30): AMIDATION
VTHXXAGLLSXSGGVVRKNFVPTDVGPFAF

SEQ ID NO: 87 - protein, 30 aa, Artificial Sequence
  CGRP peptide
  MISC_FEATURE (4)..(4): xaa = citrulline
  MISC_FEATURE (5)..(5): xaa = norleucine
  MISC_FEATURE (8)..(9): xaa = norleucine
  MISC_FEATURE (11)..(11): xaa = citrulline
  MOD_RES (30)..(30): AMIDATION
VTHXXAGXXSXSGGVVRKNFVPTDVGPFAF

SEQ ID NO: 88 - protein, 30 aa, Artificial Sequence; identical to SEQ ID NO: 87
  CGRP peptide
  MISC_FEATURE (4)..(4): xaa = citrulline
  MISC_FEATURE (5)..(5): xaa = norvaline
  MISC_FEATURE (8)..(9): xaa = norvaline
  MISC_FEATURE (11)..(11): xaa = citrulline
  MOD_RES (30)..(30): AMIDATION

SEQ ID NO: 89 - protein, 30 aa, Artificial Sequence
  CGRP peptide
  MISC_FEATURE (3)..(3): xaa = 1,2,3,4-L-Tetrahydroisoquinoline-3-Carboxylic acid
  MISC_FEATURE (4)..(4): xaa = citrulline
  MISC_FEATURE (11)..(11): xaa = citrulline
  MOD_RES (30)..(30): AMIDATION
VTXXLAGLLSXSGGVVRKNFVPTDVGPFAF

SEQ ID NO: 90 - protein, 30 aa, Artificial Sequence
  CGRP peptdie
  MISC_FEATURE (4)..(4): xaa = citrulline
  MISC_FEATURE (11)..(11): xaa = citrulline
  MOD_RES (30)..(30): AMIDATION
VTHXLAGLLTXSGGVVRKNFVPTDVGPFAF

SEQ ID NO: 91 - protein, 30 aa, Artificial Sequence
  CGRP peptdie
  MISC_FEATURE (4)..(4): xaa = citrulline
  MISC_FEATURE (7)..(7): xaa = sarcosine
  MISC_FEATURE (11)..(11): xaa = citrulline
  MOD_RES (30)..(30): AMIDATION
VTHXLAXLLSXSGGVVRKNFVPTDVGPFAF

SEQ ID NO: 92 - protein, 30 aa, Artificial Sequence
  CGRP peptdie
  MISC_FEATURE (4)..(4): xaa = citrulline
  MISC_FEATURE (5)..(5): xaa = norleucine
  MISC_FEATURE (8)..(9): xaa = norleucine
  MISC_FEATURE (11)..(11): xaa = citrulline
  MISC_FEATURE (17)..(17): xaa = homoarginine
  MISC_FEATURE (26)..(26): X = sarcosine
  MOD_RES (30)..(30): AMIDATION
VTHXXAGXXTXSGGVVXKNFVPTDVXPFAF

SEQ ID NO: 93 - protein, 30 aa, Artificial Sequence; identical to SEQ ID NO: 92
  CGRP peptdie
  MISC_FEATURE (4)..(4): xaa = homocitrulline
  MISC_FEATURE (5)..(5): xaa = norleucine
  MISC_FEATURE (8)..(9): xaa = norleucine
  MISC_FEATURE (11)..(11): xaa = homocitrulline
  MISC_FEATURE (17)..(17): xaa = homoarginine
  MISC_FEATURE (26)..(26): xaa = sarcosine
  MOD_RES (30)..(30): AMIDATION

SEQ ID NO: 94 - protein, 30 aa, Artificial Sequence; identical to SEQ ID NO: 92
  CGRP peptdie
  MISC_FEATURE (4)..(4): xaa = N-methylarginine
  MISC_FEATURE (5)..(5): xaa = norleucine
  MISC_FEATURE (8)..(9): xaa = norleucine
  MISC_FEATURE (11)..(11): xaa = N-methylarginine
  MISC_FEATURE (17)..(17): xaa = N-methylarginine
  MISC_FEATURE (26)..(26): xaa = sarcosine
  MOD_RES (30)..(30): AMIDATION

SEQ ID NO: 95 - protein, 30 aa, Artificial; identical to SEQ ID NO: 92
  CGRP peptdie
  MISC_FEATURE (4)..(4): xaa = N-methylarginine
  MISC_FEATURE (5)..(5): xaa = norvaline
  MISC_FEATURE (8)..(9): xaa = norvaline
  MISC_FEATURE (11)..(11): xaa = N-methylarginine
  MISC_FEATURE (17)..(17): xaa = N-methylarginine
  MISC_FEATURE (26)..(26): xaa = sarcosine
  MOD_RES (30)..(30): AMIDATION

SEQ ID NO: 96 - protein, 12 aa, Artificial Sequence
  CGRP peptide
  MOD_RES (12)..(12): AMIDATION
WFVPTDVGPFAF

SEQ ID NO: 97 - protein, 11 aa, Artificial Sequence
  CGRP peptide
  MOD_RES (11)..(11): AMIDATION
FVPTDVGPFAF

SEQ ID NO: 98 - protein, 30 aa, Artificial Sequence
  CGRP peptide
  MISC_FEATURE (4)..(4): xaa=Citrulline
  MOD_RES (30)..(30): AMIDATION
VTHXLAGLLSRPGGVVRKNFVPTDVGPFAF

SEQ ID NO: 99 - protein, 30 aa, Artificial Sequence
  CGRP peptide
  MISC_FEATURE (4)..(4): xaa=Citrulline
  MOD_RES (30)..(30): AMIDATION
VTHXLAGLLPRSGGVVRKNFVPTDVGPFAF

SEQ ID NO: 100 - protein, 30 aa, Artificial Sequence
  CGRP peptide
  MOD_RES (30)..(30): AMIDATION
VTHRLAGLLPRSGGVVRKNFVPTDVGPFAF

SEQ ID NO: 101 - protein, 30 aa, Artificial Sequence
  CGRP peptide
  MISC_FEATURE (17)..(17): xaa=homoarginine
  MOD_RES (30)..(30): AMIDATION
VTHQLAGLLSQSGGVVXKNFVPTDVGPFAF

SEQ ID NO: 102 - protein, 30 aa, Artificial Sequence; identical to SEQ ID NO: 85
  CGRP peptide
  MISC_FEATURE (4)..(4): xaa=citrulline
  MISC_FEATURE (11)..(11): xaa=citrulline
  MISC_FEATURE (17)..(17): xaa=homoarginine
  MOD_RES (30)..(30): AMIDATION

SEQ ID NO: 103 - protein, 30 aa, Artificial Sequence
  CGRP peptide
  MISC_FEATURE (18)..(18): xaa=4-amino-phenylalanine
  MOD_RES (30)..(30): AMIDATION
VTHRLAGLLSRSGGVVRXNFVPTDVGPFAF

SEQ ID NO: 104 - protein, 30 aa, Artificial Sequence
  CGRP peptide
  MISC_FEATURE (4)..(4): xaa=homoarginine
  MISC_FEATURE (11)..(11): xaa=citrulline
  MOD_RES (30)..(30): AMIDATION
VEHXLKGLLSXSGGVVRKNFVPTDVGPFAF

SEQ ID NO: 105 - protein, 31 aa, Artificial Sequence
  CGRP peptide
  MISC_FEATURE (1)..(1): xaa=3-(1-naphthyl)alanine
  MISC_FEATURE (5)..(5): xaa=homoarginine
  MISC_FEATURE (12)..(12): xaa=Citrulline
  MOD_RES (31)..(31): AMIDATION
XVEHXLKGLLSXSGGVVRKNFVPTDVGPFAF

SEQ ID NO: 106 - protein, 32 aa, Artificial Sequence
  CGRP peptide
  MISC_FEATURE (1)..(1): xaa=aminoisobutyric acid
  MOD_RES (1)..(1): ACETYLATION
  MISC_FEATURE (6)..(6): xaa=homoarginine
  MISC_FEATURE (13)..(13): xaa=citrulline
  MOD_RES (32)..(32): AMIDATION
XWVEHXLKGLLSXSGGVVRKNFVPTDVGPFAF

SEQ ID NO: 107 - protein, 30 aa, Artificial Sequence; identical to SEQ ID NO: 82
  CGRP peptide
  MISC_FEATURE (4)..(4): xaa=citrulline
  MISC_FEATURE (11)..(11): xaa=citrulline
  MOD_RES (30)..(30): AMIDATION

SEQ ID NO: 108 - protein, 30 aa, Artificial Sequence; identical to SEQ ID NO: 85
  CGRP peptide
  MISC_FEATURE (4)..(4): xaa=homocitruline
  MISC_FEATURE (11)..(11): xaa=homocitruline
  MISC_FEATURE (17)..(17): xaa=homoarginine
  MOD_RES (30)..(30): AMIDATION

SEQ ID NO: 109 - protein, 30 aa, Artificial Sequence; identical to SEQ ID NO: 85
  CGRP peptide
  MISC_FEATURE (4)..(4): xaa=homoarginine
  MISC_FEATURE (11)..(11): xaa=homocitruline
  MISC_FEATURE (17)..(17): xaa=homoarginine
  MOD_RES (30)..(30): AMIDATION

SEQ ID NO: 110 - protein, 30 aa, Artificial Sequence; identical to SEQ ID NO: 85
  CGRP peptide
  MISC_FEATURE (4)..(4): xaa=homoarginine
  MISC_FEATURE (11)..(11): xaa=citrulline
  MISC_FEATURE (17)..(17): xaa=homoarginine
  MOD_RES (30)..(30): AMIDATION

SEQ ID NO: 111 - protein, 30 aa, Artificial Sequence; identical to SEQ ID NO: 85
  CGRP peptide
  MISC_FEATURE (4)..(4): xaa=homoarginine
  MISC_FEATURE (11)..(11): xaa=homoarginine
  MISC_FEATURE (17)..(17): xaa=homoarginine
  MOD_RES (30)..(30): AMIDATION

SEQ ID NO: 112 - protein, 31 aa, Artificial Sequence
  CGRP peptide
  MISC_FEATURE (11)..(11): xaa=citrulline
  MISC_FEATURE (18)..(18): xaa=homoarginine
  MOD_RES (31)..(31): AMIDATION
VTHQLAGLLSXSGGVVRXKNFVPTDVGPFAF

SEQ ID NO: 113 - protein, 31 aa, Artificial Sequence
  CGRP peptide
  MISC_FEATURE (4)..(4): xaa=citrulline
  MISC_FEATURE (18)..(18): xaa=homoarginine
  MOD_RES (31)..(31): AMIDATION
VTHXLAGLLSQSGGVVRXKNFVPTDVGPFAF

SEQ ID NO: 114 - protein, 31 aa, Artificial Sequence
  CGRP peptide
  MISC_FEATURE (4)..(4): xaa=citrulline
  MISC_FEATURE (11)..(11): xaa=homoarginine
  MISC_FEATURE (18)..(18): xaa=homoarginine
  MOD_RES (31)..(31): AMIDATION
VTHXLAGLLSXSGGVVRXKNFVPTDVGPFAF

SEQ ID NO: 115 - protein, 31 aa, Artificial Sequence; identical to SEQ ID NO: 114
  CGRP peptide
  MISC_FEATURE (4)..(4): xaa=homocitruline
  MISC_FEATURE (11)..(11): xaa=homoarginine
  MISC_FEATURE (18)..(18): xaa=homoarginine
  MOD_RES (31)..(31): AMIDATION

SEQ ID NO: 116 - protein, 31 aa, Artificial Sequence
  CGRP peptide
  MISC_FEATURE (11)..(11): xaa=citrulline
  MISC_FEATURE (18)..(18): xaa=homoarginine
  MOD_RES (31)..(31): AMIDATION
VEHRLKGLLSXSGGVVRXKNFVPTDVGPFAF

SEQ ID NO: 117 - protein, 31 aa, Artificial Sequence
  CGRP peptide
  MISC_FEATURE (4)..(4): xaa=citrulline
  MISC_FEATURE (11)..(11): xaa=citrulline
  MISC_FEATURE (18)..(18): xaa=homoarginine
  MOD_RES (31)..(31): AMIDATION
VEHXLKGLLSXSGGVVRXKNFVPTDVGPFAF

SEQ ID NO: 118 - protein, 31 aa, Artificial Sequence; identical to SEQ ID NO: 116
  CGRP peptide
  MISC_FEATURE (11)..(11): xaa=homoarginine
  MISC_FEATURE (18)..(18): xaa=homoarginine
  MOD_RES (31)..(31): AMIDATION

SEQ ID NO: 119 - protein, 31 aa, Artificial Sequence
  CGRP peptide
  MISC_FEATURE (18)..(18): xaa=homoarginine
  MOD_RES (31)..(31): AMIDATION
VEHRLKGLLSQSGGVVRXKNFVPTDVGPFAF

SEQ ID NO: 120 - protein, 30 aa, Artificial Sequence; identical to SEQ ID NO: 85
  CGRP peptide
  MISC_FEATURE (4)..(4): xaa=citrulline
  MISC_FEATURE (11)..(11): xaa=citrulline
  MISC_FEATURE (17)..(17): xaa=homoarginine
  MOD_RES (30)..(30): AMIDATION

SEQ ID NO: 121 - protein, 30 aa, Artificial Sequence
  CGRP peptide
  MISC_FEATURE (4)..(4): xaa=citrulline
  MISC_FEATURE (11)..(11): xaa=citrulline
  MISC_FEATURE (17)..(17): xaa=homoarginine
  MISC_FEATURE (27)..(27): xaa=Octahydroindole-2-Carboxylic Acid
  MOD_RES (30)..(30): AMIDATION
VTHXLAGLLSXSGGVVXKNFVPTDVGXFAF

SEQ ID NO: 122 - protein, 30 aa, Artificial Sequence
  CGRP peptide
  MISC_FEATURE (4)..(4): xaa=citrulline
  MISC_FEATURE (11)..(11): xaa=citrulline
  MISC_FEATURE (17)..(17): xaa=homoarginine
  MISC_FEATURE (28)..(28): xaa=3-(1-naphthyl)alanine
  MOD_RES (30)..(30): AMIDATION
VTHXLAGLLSXSGGVVXKNFVPTDVGPXAF

SEQ ID NO: 123 - protein, 30 aa, Artificial Sequence; identical to SEQ ID NO: 85
  CGRP peptide
  MISC_FEATURE (4)..(4): xaa=citrulline
  MISC_FEATURE (11)..(11): xaa=citrulline
  MISC_FEATURE (17)..(17): xaa=4-guanidinyl phenylalanine
  MOD_RES (30)..(30): AMIDATION

SEQ ID NO: 124 - protein, 30 aa, Artificial Sequence; identical to SEQ ID NO: 122
  CGRP peptide
  MISC_FEATURE (4)..(4): xaa=citrulline
  MISC_FEATURE (11)..(11): xaa=citrulline
  MISC_FEATURE (17)..(17): xaa=homoarginine
  MISC_FEATURE (27)..(27): xaa=4,4'-biphenyl alanine
  misc_feature (28)..(28): Xaa can be any naturally occurring amino acid
  MOD_RES (30)..(30): AMIDATION

SEQ ID NO: 125 - protein, 30 aa, Artificial Sequence; identical to SEQ ID NO: 122
  CGRP peptide
  MISC_FEATURE (4)..(4): xaa=homoarginine
  MISC_FEATURE (11)..(11): xaa=citrulline
  MISC_FEATURE (17)..(17): xaa=homoarginine
  MISC_FEATURE (28)..(28): xaa=3-(2-naphthyl)alanine
  MOD_RES (30)..(30): AMIDATION

SEQ ID NO: 126 - protein, 30 aa, Artificial Sequence; identical to SEQ ID NO: 122
  CGRP peptide
  MISC_FEATURE (4)..(4): xaa=citrulline
  MISC_FEATURE (11)..(11): xaa=citrulline
  MISC_FEATURE (17)..(17): xaa=homoarginine
  MISC_FEATURE (28)..(28): xaa=Indanyl glycine
  MOD_RES (30)..(30): AMIDATION

SEQ ID NO: 127 - protein, 30 aa, Artificial Sequence
  CGRP peptide
  MISC_FEATURE (4)..(4): xaa=citrulline
  MISC_FEATURE (11)..(11): xaa=citrulline
  MISC_FEATURE (17)..(17): xaa=homoarginine
  MISC_FEATURE (20)..(20): xaa=4-iodophenylalanine
  MISC_FEATURE (28)..(28): xaa=4-iodophenylalanine
  MOD_RES (30)..(30): AMIDATION
VTHXLAGLLSXSGGVVXKNXVPTDVGPXAF

SEQ ID NO: 128 - protein, 32 aa, Artificial Sequence
  CGRP peptide
  MOD_RES (1)..(1): ACETYLATION
  MISC_FEATURE (6)..(6): xaa=citrulline
  MISC_FEATURE (13)..(13): xaa=citrulline
  MOD_RES (32)..(32): AMIDATION
KWVTHXLAGLLSXSGGVVRKNFVPTDVGPKAF

SEQ ID NO: 129 - protein, 31 aa, Artificial Sequence
  CGRP peptide
  MISC_FEATURE: Lactam bridge between residues 9 and 13.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION
WVTHXLAGELSXKGGVVXKNFVPTDVGXFAF

SEQ ID NO: 130 - protein, 31 aa, Artificial Sequence
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa = Tic=1,2,3,4-L-Tetrahydroisoquinoline-3-Carboxylic acid
  MOD_RES (31)..(31): AMIDATION
WVTHXLAGLLSXSGGVVXKNFVPTDVGXFAF

SEQ ID NO: 131 - protein, 31 aa, Artificial Sequence
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (29)..(29): xaa= Tic=1,2,3,4-L-Tetrahydroisoquinoline-3-Carboxylic acid
  MOD_RES (31)..(31): AMIDATION
WVTHXLAGLLSXSGGVVXKNFVPTDVGPXAF

SEQ ID NO: 132 - protein, 31 aa, Artificial Sequence
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (23)..(23): xaa=Octahydroindole-2-Carboxylic Acid
  MISC_FEATURE (28)..(28): xaa=Octahydroindole-2-Carboxylic Acid
  MISC_FEATURE (31)..(31): xaa=3-(2-naphthyl)alanine
  MOD_RES (31)..(31): AMIDATION
WVTHXLAGLLSXSGGVVXKNFVXTDVGXFAX

SEQ ID NO: 133 - protein, 31 aa, Artificial Sequence
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (23)..(23): xaa=Octahydroindole-2-Carboxylic Acid
  MISC_FEATURE (29)..(29): xaa=3-(1-naphthyl)alanine
  MISC_FEATURE (31)..(31): xaa=3-(2-naphthyl)alanine
  MOD_RES (31)..(31): AMIDATION
WVTHXLAGLLSXSGGVVXKNFVXTDVGPXAX

SEQ ID NO: 134 - protein, 31 aa, Artificial Sequence
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (23)..(23): xaa=Octahydroindole-2-Carboxylic Acid
  MISC_FEATURE (29)..(29): xaa=4,4'-biphenyl alanine
  MOD_RES (31)..(31): AMIDATION
WVTHXLAGLLSXSGGVVXKNFVXTDVGPXAF

SEQ ID NO: 135 - protein, 31 aa, Artificial Sequence
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (23)..(23): xaa=Octahydroindole-2-Carboxylic Acid
  MISC_FEATURE (31)..(31): xaa=3-(2-naphthyl)alanine
  MOD_RES (31)..(31): AMIDATION
WVTHXLAGLLSXSGGVVXKNFVXTDVGPFAX

SEQ ID NO: 136 - protein, 31 aa, Artificial Sequence
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (21)..(21): xaa=4-iodophenylalanine
  MISC_FEATURE (23)..(23): xaa=Octahydroindole-2-Carboxylic Acid
  MISC_FEATURE (29)..(29): xaa=4-iodophenylalanine
  MOD_RES (31)..(31): AMIDATION
WVTHXLAGLLSXSGGVVXKNXVXTDVGPXAF

SEQ ID NO: 137 - protein, 31 aa, Artificial Sequence
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (21)..(21): xaa=3-(2-naphthyl)alanine
  MISC_FEATURE (28)..(28): xaa=Octahydroindole-2-Carboxylic Acid
  MOD_RES (31)..(31): AMIDATION
WVTHXLAGLLSXSGGVVXKNXVPTDVGXFAF

SEQ ID NO: 138 - protein, 31 aa, Artificial Sequence
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (21)..(21): xaa=3-(2-naphthyl)alanine
  MISC_FEATURE (28)..(28): xaa=Octahydroindole-2-Carboxylic Acid
  MISC_FEATURE (31)..(31): xaa=3-(2-naphthyl)alanine
  MOD_RES (31)..(31): AMIDATION
WVTHXLAGLLSXSGGVVXKNXVPTDVGXFAX

SEQ ID NO: 139 - protein, 31 aa, Artificial Sequence
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (21)..(21): xaa=3-(2-naphthyl)alanine
  MISC_FEATURE (23)..(23): xaa=Octahydroindole-2-Carboxylic Acid
  MISC_FEATURE (28)..(28): xaa=Octahydroindole-2-Carboxylic Acid
  MISC_FEATURE (31)..(31): xaa=3-(2-naphthyl)alanine
  MOD_RES (31)..(31): AMIDATION
WVTHXLAGLLSXSGGVVXKNXVXTDVGXFAX

SEQ ID NO: 140 - protein, 31 aa, Artificial Sequence
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (28)..(28): xaa = Tic=1,2,3,4-L-Tetrahydroisoquinoline-3-Carboxylic acid
  MOD_RES (31)..(31): AMIDATION
WVTHXLAGLLSXSGGVVRKNFVPTDVGXFAF

SEQ ID NO: 141 - protein, 31 aa, Artificial Sequence; identical to SEQ ID NO: 140
  dup of 140, 956 and 957
  MOD_RES (1)..(1): ACETYLATION
  MISC_FEATURE (5)..(5): xaa=citrulline
  MISC_FEATURE (12)..(12): xaa=citrulline
  MISC_FEATURE (28)..(28): xaa = Tic=1,2,3,4-L-Tetrahydroisoquinoline-3-Carboxylic acid
  MOD_RES (31)..(31): AMIDATION

SEQ ID NO: 142 - protein, 31 aa, Artificial Sequence; identical to SEQ ID NO: 130
  DUP OF 130, 143, 946, 958, AND 959
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa= Tic=1,2,3,4-L-Tetrahydroisoquinoline-3-Carboxylic acid
  MOD_RES (31)..(31): AMIDATION

SEQ ID NO: 143 - protein, 31 aa, Artificial Sequence; identical to SEQ ID NO: 130
  DUP OF 130, 142, 946, 958, AND 959
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa = Tic=1,2,3,4-L-Tetrahydroisoquinoline-3-Carboxylic acid
  MOD_RES (31)..(31): AMIDATION

SEQ ID NO: 144 - protein, 31 aa, Artificial Sequence; identical to SEQ ID NO: 131
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (29)..(29): xaa=3-(1-naphthyl)alanine
  MOD_RES (31)..(31): AMIDATION

SEQ ID NO: 145 - protein, 31 aa, Artificial Sequence; identical to SEQ ID NO: 130
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION

SEQ ID NO: 146 - protein, 31 aa, Artificial Sequence
  CGRP peptide
  MOD_RES (1)..(1): AMIDATION
  MISC_FEATURE (5)..(5): xaa=citrulline
  MISC_FEATURE (12)..(12): xaa=citrulline
  MISC_FEATURE (29)..(29): xaa = Tic=1,2,3,4-L-Tetrahydroisoquinoline-3-Carboxylic acid
  MOD_RES (31)..(31): AMIDATION
WVTHXLAGLLSXSGGVVRKNFVPTDVGPXAF

SEQ ID NO: 147 - protein, 31 aa, Artificial Sequence
  CGRP peptide
  MOD_RES (1)..(1): ACETYLATION
  MISC_FEATURE (19)..(19): PEGylated
  MOD_RES (31)..(31): AMIDATION
WVTHRLAGLASRPGGVVRKNFVPTDVGPFAF

SEQ ID NO: 148 - protein, 31 aa, Artificial Sequence
  CGRP peptide
  MOD_RES (1)..(1): ACETYLATION
  MISC_FEATURE (5)..(5): xaa=citrulline
  MISC_FEATURE (19)..(19): PEGylated
  MOD_RES (31)..(31): AMIDATION
WVTHXLAGLASRPGGVVRKNFVPTDVGPFAF

SEQ ID NO: 149 - protein, 31 aa, Artificial Sequence
  CGRP peptide
  MOD_RES (1)..(1): ACETYLATION
  MISC_FEATURE (5)..(5): xaa=citrulline
  MISC_FEATURE (19)..(19): PEGylated
  MOD_RES (31)..(31): AMIDATION
WVTHXLAGLLSRPGGVVRKNFVPTDVGPFAF

SEQ ID NO: 150 - protein, 31 aa, Artificial Sequence
  CGRP peptide
  MOD_RES (1)..(1): ACETYLATION
  MISC_FEATURE (5)..(5): xaa-citrulline
  MISC_FEATURE (19)..(19): PEGylated
  MOD_RES (31)..(31): AMIDATION
WVTHXLAGLLPRSGGVVRKNFVPTDVGPFAF

SEQ ID NO: 151 - protein, 31 aa, Artificial Sequence
  CGRP peptide
  MOD_RES (1)..(1): ACETYLATION
  MISC_FEATURE (19)..(19): PEGylated
  MOD_RES (31)..(31): AMIDATION
WVTHRLAGLLPRSGGVVRKNFVPTDVGPFAF

SEQ ID NO: 152 - protein, 31 aa, Artificial Sequence
  CGRP peptide
  MOD_RES (1)..(1): ACETYLATION
  MISC_FEATURE (18)..(18): xaa=homoarginine
  MISC_FEATURE (19)..(19): PEGylated
  MOD_RES (31)..(31): AMIDATION
WVTHQLAGLLSQSGGVVXKNFVPTDVGPFAF

SEQ ID NO: 153 - protein, 31 aa, Artificial Sequence; identical to SEQ ID NO: 71
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (19)..(19): PEGylated
  MOD_RES (31)..(31): AMIDATION

SEQ ID NO: 154 - protein, 31 aa, Artificial Sequence
  CGRP peptide
  MOD_RES (1)..(1): ACETYLATION
  MISC_FEATURE (19)..(19): xaa=4-amino-phenylalanine; PEGylated
  MOD_RES (31)..(31): AMIDATION
WVTHRLAGLLSRSGGVVRXNFVPTDVGPFAF

SEQ ID NO: 155 - protein, 31 aa, Artificial Sequence
  CGRP peptide
  MISC_FEATURE: Lactam bridge between residues 3 and 7.
  MOD_RES (1)..(1): ACETYLATION
  MISC_FEATURE (5)..(5): xaa=homoarginine
  MISC_FEATURE (12)..(12): xaa=citrulline
  MISC_FEATURE (19)..(19): PEGylated
  MOD_RES (31)..(31): AMIDATION
WVEHXLKGLLSXSGGVVRKNFVPTDVGPFAF

SEQ ID NO: 156 - protein, 31 aa, Artificial Sequence; identical to SEQ ID NO: 105
  CGRP peptide
  MISC_FEATURE: Lactam bridge between residues 3 and 7.
  MISC_FEATURE (1)..(1): xaa=3-(1-naphthyl)alanine
  MOD_RES (1)..(1): ACETYLATION
  MISC_FEATURE (5)..(5): xaa=homoarginine
  MISC_FEATURE (12)..(12): xaa=citrulline
  MISC_FEATURE (19)..(19): PEGylated
  MOD_RES (31)..(31): AMIDATION

SEQ ID NO: 157 - protein, 32 aa, Artificial Sequence; identical to SEQ ID NO: 106
  CGRP peptide
  MISC_FEATURE: Lactam bridge between residues 3 and 7.
  MISC_FEATURE (1)..(1): xaa=aminoisobutyric acid
  MOD_RES (1)..(1): ACETYLATION
  MISC_FEATURE (6)..(6): xaa=homoarginine
  MISC_FEATURE (13)..(13): xaa=citrulline
  MISC_FEATURE (20)..(20): PEGylated
  MOD_RES (32)..(32): AMIDATION

SEQ ID NO: 158 - protein, 31 aa, Artificial Sequence; identical to SEQ ID NO: 25
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (19)..(19): PEGylated
  MOD_RES (31)..(31): AMIDATION

SEQ ID NO: 159 - protein, 31 aa, Artificial Sequence; identical to SEQ ID NO: 71
  CGRP peptide
  MOD_RES (1)..(1): ACETYLATION
  MISC_FEATURE (5)..(5): xaa=homocitruline
  MISC_FEATURE (12)..(12): xaa=homocitruline
  MISC_FEATURE (18)..(18): xaa=homoarginine
  MISC_FEATURE (19)..(19): PEGylated
  MOD_RES (31)..(31): AMIDATION

SEQ ID NO: 160 - protein, 31 aa, Artificial Sequence; identical to SEQ ID NO: 71
  CGRP peptide
  MOD_RES (1)..(1): ACETYLATION
  MISC_FEATURE (5)..(5): xaa=homoarginine
  MISC_FEATURE (12)..(12): xaa=homocitruline
  MISC_FEATURE (18)..(18): xaa=homoarginine
  MISC_FEATURE (19)..(19): PEGylated
  MOD_RES (31)..(31): AMIDATION

SEQ ID NO: 161 - protein, 31 aa, Artificial Sequence; identical to SEQ ID NO: 71
  CGRP peptide
  MOD_RES (1)..(1): ACETYLATION
  MISC_FEATURE (5)..(5): xaa=homoarginine
  MISC_FEATURE (12)..(12): xaa=citrulline
  MISC_FEATURE (18)..(18): xaa=homoarginine
  MISC_FEATURE (19)..(19): PEGylated
  MOD_RES (31)..(31): AMIDATION

SEQ ID NO: 162 - protein, 31 aa, Artificial Sequence; identical to SEQ ID NO: 71
  CGRP peptide
  MOD_RES (1)..(1): ACETYLATION
  MISC_FEATURE (5)..(5): xaa=homoarginine
  MISC_FEATURE (12)..(12): xaa=homoarginine
  MISC_FEATURE (18)..(18): xaa=homoarginine
  MISC_FEATURE (19)..(19): PEGylated
  MOD_RES (31)..(31): AMIDATION

SEQ ID NO: 163 - protein, 32 aa, Artificial Sequence
  CGRP peptide
  MOD_RES (1)..(1): ACETYLATION
  MISC_FEATURE (12)..(12): xaa=citrulline
  MISC_FEATURE (19)..(19): xaa=homoarginine
  MISC_FEATURE (20)..(20): PEGylated
  MOD_RES (32)..(32): AMIDATION
WVTHQLAGLLSXSGGVVRXKNFVPTDVGPFAF

SEQ ID NO: 164 - protein, 32 aa, Artificial Sequence
  CGRP peptide
  MOD_RES (1)..(1): ACETYLATION
  MISC_FEATURE (5)..(5): xaa=citrulline
  MISC_FEATURE (19)..(19): xaa=homoarginine
  MISC_FEATURE (20)..(20): PEGylated
  MOD_RES (32)..(32): AMIDATION
WVTHXLAGLLSQSGGVVRXKNFVPTDVGPFAF

SEQ ID NO: 165 - protein, 32 aa, Artificial Sequence
  CGRP peptide
  MOD_RES (1)..(1): ACETYLATION
  MISC_FEATURE (5)..(5): xaa=citrulline
  MISC_FEATURE (12)..(12): xaa=homoarginine
  MISC_FEATURE (19)..(19): xaa=homoarginine
  MISC_FEATURE (20)..(20): PEGylated
  MOD_RES (32)..(32): AMIDATION
WVTHXLAGLLSXSGGVVRXKNFVPTDVGPFAF

SEQ ID NO: 166 - protein, 32 aa, Artificial Sequence; identical to SEQ ID NO: 165
  CGRP peptide
  MOD_RES (1)..(1): ACETYLATION
  MISC_FEATURE (5)..(5): xaa=homocitruline
  MISC_FEATURE (12)..(12): xaa=homoarginine
  MISC_FEATURE (19)..(19): xaa=homoarginine
  MISC_FEATURE (20)..(20): PEGylated
  MOD_RES (32)..(32): AMIDATION

SEQ ID NO: 167 - protein, 32 aa, Artificial Sequence
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (19)..(19): xaa=homoarginine
  MISC_FEATURE (20)..(20): PEGylated
  MOD_RES (32)..(32): AMIDATION
WVEHRLKGLLSXSGGVVRXKNFVPTDVGPFAF

SEQ ID NO: 168 - protein, 32 aa, Artificial Sequence
  CGRP peptide
  MISC_FEATURE: Lactam bridge between residues 3 and 7.
  MOD_RES (1)..(1): ACETYLATION
  MISC_FEATURE (5)..(5): xaa=citrulline
  MISC_FEATURE (12)..(12): xaa=citrulline
  MISC_FEATURE (19)..(19): xaa=homoarginine
  MISC_FEATURE (20)..(20): PEGylated
  MOD_RES (32)..(32): AMIDATION
WVEHXLKGLLSXSGGVVRXKNFVPTDVGPFAF

SEQ ID NO: 169 - protein, 32 aa, Artificial Sequence; identical to SEQ ID NO: 167
  CGRP peptide
  MISC_FEATURE: Lactam bridge between residues 3 and 7.
  MOD_RES (1)..(1): ACETYLATION
  MISC_FEATURE (12)..(12): xaa=homoarginine
  MISC_FEATURE (19)..(19): xaa=homoarginine
  MISC_FEATURE (20)..(20): PEGylated
  MOD_RES (32)..(32): AMIDATION

SEQ ID NO: 170 - protein, 32 aa, Artificial Sequence
  CGRP peptide
  MISC_FEATURE: Lactam bridge between residues 3 and 7.
  MOD_RES (1)..(1): ACETYLATION
  MISC_FEATURE (19)..(19): xaa=homoarginine
  MISC_FEATURE (20)..(20): PEGylated
  MOD_RES (32)..(32): AMIDATION
WVEHRLKGLLSQSGGVVRXKNFVPTDVGPFAF

SEQ ID NO: 171 - protein, 31 aa, Artificial Sequence; identical to SEQ ID NO: 71
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (19)..(19): PEGylated
  MOD_RES (31)..(31): AMIDATION

SEQ ID NO: 172 - protein, 31 aa, Artificial Sequence; identical to SEQ ID NO: 130
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (19)..(19): PEGylated
  MISC_FEATURE (28)..(28): xaa=Octahydroindole-2-Carboxylic Acid
  MOD_RES (31)..(31): AMIDATION

SEQ ID NO: 173 - protein, 31 aa, Artificial Sequence; identical to SEQ ID NO: 131
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (19)..(19): PEGylated
  MISC_FEATURE (29)..(29): xaa=3-(1-naphthyl)alanine
  MOD_RES (31)..(31): AMIDATION

SEQ ID NO: 174 - protein, 31 aa, Artificial Sequence; identical to SEQ ID NO: 71
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=4-guanidinyl phenylalanine
  MISC_FEATURE (19)..(19): PEGylated
  MOD_RES (31)..(31): AMIDATION

SEQ ID NO: 175 - protein, 31 aa, Artificial Sequence; identical to SEQ ID NO: 131
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (19)..(19): PEGylated
  MISC_FEATURE (29)..(29): xaa=4,4'-biphenyl alanine
  MOD_RES (31)..(31): AMIDATION

SEQ ID NO: 176 - protein, 31 aa, Artificial Sequence; identical to SEQ ID NO: 131
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (19)..(19): PEGylated
  MISC_FEATURE (29)..(29): xaa=Indanyl glycine
  MOD_RES (31)..(31): AMIDATION

SEQ ID NO: 177 - protein, 31 aa, Artificial Sequence; identical to SEQ ID NO: 131
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (19)..(19): PEGylated
  MISC_FEATURE (29)..(29): xaa=Indanyl glycine
  MOD_RES (31)..(31): AMIDATION

SEQ ID NO: 178 - protein, 31 aa, Artificial Sequence
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (19)..(19): PEGylated
  MISC_FEATURE (21)..(21): xaa=4-iodophenylalanine
  MISC_FEATURE (29)..(29): xaa=4-iodophenylalanine
  MOD_RES (31)..(31): AMIDATION
WVTHXLAGLLSXSGGVVXKNXVPTDVGPXAF

SEQ ID NO: 179 - protein, 31 aa, Artificial Sequence; identical to SEQ ID NO: 71
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (19)..(19): PEGylated
  MOD_RES (31)..(31): AMIDATION

SEQ ID NO: 180 - protein, 31 aa, Artificial Sequence
  CGRP peptide
  MISC_FEATURE: Lactam bridge between residues 3 and 7.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION
WVEHXLKGLLSXSGGVVXKNFVPTDVGXFAF

SEQ ID NO: 181 - protein, 31 aa, Artificial Sequence
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION
WVEHRLKGLLSXSGGVVXKNFVPTDVGXFAF

SEQ ID NO: 182 - protein, 31 aa, Artificial Sequence
  CGRP peptide
  MISC_FEATURE: Lactam bridge between residues 3 and 7.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
WVEHXLKGLLSXSGGVVXKNFVPXDVGXFAF

SEQ ID NO: 183 - protein, 31 aa, Artificial Sequence
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
WVEHRLKGLLSXSGGVVXKNFVPXDVGXFAF

SEQ ID NO: 184 - protein, 31 aa, Artificial Sequence; identical to SEQ ID NO: 180
  CGRP peptide
  MISC_FEATURE: Lactam bridge between residues 3 and 7.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION

SEQ ID NO: 185 - protein, 31 aa, Artificial Sequence; identical to SEQ ID NO: 181
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION

SEQ ID NO: 186 - protein, 31 aa, Artificial Sequence; identical to SEQ ID NO: 182
  CGRP peptide
  MISC_FEATURE: Lactam bridge between residues 3 and 7.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION

SEQ ID NO: 187 - skipped

SEQ ID NO: 188 - protein, 31 aa, Artificial Sequence
  CGRP peptide
  MISC_FEATURE: Lactam bridge between residues 3 and 7.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=Octahydroindole-2-Carboxylic Acid
  MISC_FEATURE (31)..(31): xaa=3-(2-naphthyl)alanine
  MOD_RES (31)..(31): AMIDATION
WVEHXLKGLLSXSGGVVXKNFVPXDVGXFAX

SEQ ID NO: 189 - protein, 31 aa, Artificial Sequence; identical to SEQ ID NO: 180
  CGRP peptide
  MISC_FEATURE: Lactam bridge between residues 3 and 7.
  MOD_RES (1)..(1): ACETYLATION
  MISC_FEATURE (5)..(5): xaa=homoarginine
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION

SEQ ID NO: 190 - protein, 31 aa, Artificial Sequence
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION
WVEHKLKGLLSXSGGVVXKNFVPTDVGXFAF

SEQ ID NO: 191 - protein, 31 aa, Artificial Sequence; identical to SEQ ID NO: 182
  CGRP peptide
  MISC_FEATURE: Lactam bridge between residues 3 and 7.
  MOD_RES (1)..(1): ACETYLATION
  MISC_FEATURE (5)..(5): xaa=homocitruline
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION

SEQ ID NO: 192 - protein, 31 aa, Artificial Sequence; identical to SEQ ID NO: 182
  CGRP peptide
  MISC_FEATURE: Lactam bridge between residues 3 and 7.
  MOD_RES (1)..(1): ACETYLATION
  MISC_FEATURE (5)..(5): xaa=ornithine
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION

SEQ ID NO: 193 - protein, 31 aa, Artificial Sequence
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=Octahydroindole-2-Carboxylic Acid
  MISC_FEATURE (31)..(31): xaa=3-(2-naphthyl)alanine
  MOD_RES (31)..(31): AMIDATION
WVEHHLKGLLSXSGGVVXKNFVPXDVGXFAX

SEQ ID NO: 194 - protein, 31 aa, Artificial Sequence
  CGRP peptide
  MISC_FEATURE: Lactam bridge between residues 3 and 7.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION
WVDHXLKGLLSXSGGVVXKNFVPTDVGXFAF

SEQ ID NO: 195 - protein, 31 aa, Artificial Sequence
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION
WVDHRLKGLLSXSGGVVXKNFVPTDVGXFAF

SEQ ID NO: 196 - protein, 31 aa, Artificial Sequence
  CGRP peptide
  MISC_FEATURE: Lactam bridge between residues 3 and 7.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
WVDHXLKGLLSXSGGVVXKNFVPXDVGXFAF

SEQ ID NO: 197 - protein, 31 aa, Artificial Sequence
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
WVDHRLKGLLSXSGGVVXKNFVPXDVGXFAF

SEQ ID NO: 198 - protein, 31 aa, Artificial Sequence
  CGRP peptide
  MISC_FEATURE: Lactam bridge between residues 3 and 7.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=Octahydroindole-2-Carboxylic Ac
  MISC_FEATURE (31)..(31): xaa=3-(2-naphthyl)alanine
  MOD_RES (31)..(31): AMIDATION
WVDHXLKGLLSXSGGVVXKNFVPXDVGXFAX

SEQ ID NO: 199 - protein, 31 aa, Artificial Sequence; identical to SEQ ID NO: 180
  CGRP peptide
  MISC_FEATURE: Lactam bridge between residues 3 and 7.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=citrulline
  MISC_FEATURE (28)..(28): xaa=Octahydroindole-2-Carboxylic Acid
  MOD_RES (31)..(31): AMIDATION

SEQ ID NO: 200 - protein, 31 aa, Artificial Sequence; identical to SEQ ID NO: 181
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (18)..(18): xaa=citrulline
  MISC_FEATURE (28)..(28): xaa=Octahydroindole-2-Carboxylic Acid
  MOD_RES (31)..(31): AMIDATION

SEQ ID NO: 201 - protein, 31 aa, Artificial Sequence; identical to SEQ ID NO: 182
  CGRP peptide
  MISC_FEATURE: Lactam bridge between residues 3 and 7.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=citrulline
  MISC_FEATURE (24)..(24): xaa=Nalpha-methyl threonine
  MISC_FEATURE (28)..(28): xaa=Octahydroindole-2-Carboxylic Aci
  MOD_RES (31)..(31): AMIDATION

SEQ ID NO: 202 - protein, 31 aa, Artificial Sequence; identical to SEQ ID NO: 183
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (18)..(18): xaa=citrulline
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION

SEQ ID NO: 203 - protein, 31 aa, Artificial Sequence; identical to SEQ ID NO: 188
  CGRP peptide
  MISC_FEATURE: Lactam bridge between residues 3 and 7.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=citrulline
  MISC_FEATURE (24)..(24): xaa=Nalpha-methyl threonine
  MISC_FEATURE (28)..(28): xaa=Octahydroindole-2-Carboxylic Acid
  MISC_FEATURE (31)..(31): xaa=3-(2-naphthyl)alanine
  MOD_RES (31)..(31): AMIDATION

SEQ ID NO: 204 - protein, 31 aa, Artificial Sequence; identical to SEQ ID NO: 180
  CGRP peptide
  MISC_FEATURE: Lactam bridge between residues 3 and 7.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=4-guanidinyl phenylalanine
  MISC_FEATURE (28)..(28): xaa=Octahydroindole-2-Carboxylic Acid
  MOD_RES (31)..(31): AMIDATION

SEQ ID NO: 205 - protein, 31 aa, Artificial Sequence; identical to SEQ ID NO: 181
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (18)..(18): xaa=4-guanidinyl phenylalanine
  MISC_FEATURE (28)..(28): xaa=Octahydroindole-2-Carboxylic Acid
  MOD_RES (31)..(31): AMIDATION

SEQ ID NO: 206 - protein, 31 aa, Artificial Sequence; identical to SEQ ID NO: 182
  CGRP peptide
  MISC_FEATURE: Lactam bridge between residues 3 and 7.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=4-guanidinyl phenylalanine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION

SEQ ID NO: 207 - protein, 31 aa, Artificial Sequence; identical to SEQ ID NO: 183
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (18)..(18): xaa=4-guanidinyl phenylalanine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION

SEQ ID NO: 208 - protein, 31 aa, Artificial Sequence; identical to SEQ ID NO: 188
  CGRP peptide
  MISC_FEATURE: Lactam bridge between residues 3 and 7.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=4-guanidinyl phenylalanine
  MISC_FEATURE (24)..(24): xaa=Nalpha-methyl threonine
  MISC_FEATURE (28)..(28): xaa=Octahydroindole-2-Carboxylic Acid
  MISC_FEATURE (31)..(31): xaa=3-(2-naphthyl)alanine
  MOD_RES (31)..(31): AMIDATION

SEQ ID NO: 209 - protein, 31 aa, Artificial Sequence
  CGRP peptide
  MISC_FEATURE: Lactam bridge between residues 3 and 7.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): ACETYLATION
WVEHXLKGLLSXSGGVVXKNFVPXDVGXFAW

SEQ ID NO: 210 - protein, 31 aa, Artificial Sequence
  CGRP peptide
  MISC_FEATURE: Lactam bridge between residues 3 and 7.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
WVEHXLKGLLSXSGGVVXKNFVPXDVGXFAH

SEQ ID NO: 211 - protein, 31 aa, Artificial Sequence; identical to SEQ ID NO: 188
  CGRP peptide
  MISC_FEATURE: Lactam bridge between residues 3 and 7.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=Octahydroindole-2-Carboxylic Acid
  MISC_FEATURE (31)..(31): xaa=3-(1-naphthyl)alanine
  MOD_RES (31)..(31): AMIDATION

SEQ ID NO: 212 - protein, 31 aa, Artificial Sequence; identical to SEQ ID NO: 188
  CGRP peptide
  MISC_FEATURE: Lactam bridge between residues 3 and 7.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=Octahydroindole-2-Carboxylic Acid
  MISC_FEATURE (31)..(31): xaa=4,4'-biphenyl alanine
  MOD_RES (31)..(31): AMIDATION

SEQ ID NO: 213 - protein, 31 aa, Artificial Sequence; identical to SEQ ID NO: 188
  CGRP peptide
  MISC_FEATURE: Lactam bridge between residues 3 and 7.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=Octahydroindole-2-Carboxylic Acid
  MISC_FEATURE (31)..(31): xaa=1,2,3,4-L-Tetrahydroisoquinoline-3-Carboxylic acid
  MOD_RES (31)..(31): AMIDATION

SEQ ID NO: 214 - protein, 31 aa, Artificial Sequence
  CGRP peptide
  MISC_FEATURE: Lactam bridge between residues 3 and 7.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
WVEHXLKGLLSXSGGVVXKNFVPXDVGXFAY

SEQ ID NO: 215 - protein, 31 aa, Artificial Sequence; identical to SEQ ID NO: 181
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION

SEQ ID NO: 216 - protein, 31 aa, Artificial Sequence; identical to SEQ ID NO: 181
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (18)..(18): xaa=homoarginine
  MISC_FEATURE (28)..(28): xaa=pipecolic acid
  MOD_RES (31)..(31): AMIDATION

SEQ ID NO: 217 - protein, 31 aa, Artificial Sequence; identical to SEQ ID NO: 181
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (18)..(18): xaa=homoarginine
  MISC_FEATURE (28)..(28): xaa=hydroxy proline
  MOD_RES (31)..(31): AMIDATION

SEQ ID NO: 218 - protein, 31 aa, Artificial Sequence; identical to SEQ ID NO: 181
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (18)..(18): xaa=homoarginine
  MISC_FEATURE (28)..(28): xaa=hydroxy proline
  MOD_RES (31)..(31): AMIDATION

SEQ ID NO: 219 - protein, 31 aa, Artificial Sequence; identical to SEQ ID NO: 181
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (18)..(18): xaa=homoarginine
  MISC_FEATURE (28)..(28): xaa=2-aminoindane-2-carboxylic acid
  MOD_RES (31)..(31): AMIDATION

SEQ ID NO: 220 - protein, 31 aa, Artificial Sequence; identical to SEQ ID NO: 181
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (18)..(18): xaa=homoarginine
  MISC_FEATURE (28)..(28): xaa=2-aminoindane-2-carboxylic acid
  MOD_RES (31)..(31): AMIDATION

SEQ ID NO: 221 - protein, 31 aa, Artificial Sequence; identical to SEQ ID NO: 181
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (18)..(18): xaa=homoarginine
  MISC_FEATURE (28)..(28): xaa=aminoisobutyric acid
  MOD_RES (31)..(31): AMIDATION

SEQ ID NO: 222 - protein, 31 aa, Artificial Sequence; identical to SEQ ID NO: 181
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (18)..(18): xaa=homoarginine
  MISC_FEATURE (28)..(28): xaa=Thiazolidine-4-carboxylic acid
  MOD_RES (31)..(31): AMIDATION

SEQ ID NO: 223 - protein, 31 aa, Artificial Sequence; identical to SEQ ID NO: 181
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (18)..(18): xaa=homoarginine
  MISC_FEATURE (28)..(28): xaa=Sarcosine
  MOD_RES (31)..(31): AMIDATION

SEQ ID NO: 224 - protein, 31 aa, Artificial Sequence; identical to SEQ ID NO: 181
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (18)..(18): xaa=homoarginine
  MISC_FEATURE (28)..(28): xaa=Sarcosine
  MOD_RES (31)..(31): AMIDATION

SEQ ID NO: 225 - protein, 31 aa, Artificial Sequence; identical to SEQ ID NO: 181
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (18)..(18): xaa=homoarginine
  MISC_FEATURE (28)..(28): xaa=1,2,3,4-Tetrahydronorharman-3-Carboxylic acid
  MOD_RES (31)..(31): AMIDATION

SEQ ID NO: 226 - protein, 31 aa, Artificial Sequence; identical to SEQ ID NO: 181
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION

SEQ ID NO: 227 - protein, 31 aa, Artificial Sequence; identical to SEQ ID NO: 181
  CGRP peptide
  MISC_FEATURE: Lactam bridge between residues 3 and 7.
  MOD_RES (1)..(1): AMIDATION
  MISC_FEATURE (12)..(12): xaa=citrulline
  MISC_FEATURE (18)..(18): xaa=homoarginine
  MISC_FEATURE (28)..(28): xaa=pipecolic acid
  MOD_RES (31)..(31): AMIDATION

SEQ ID NO: 228 - protein, 31 aa, Artificial Sequence; identical to SEQ ID NO: 181
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (18)..(18): xaa=homoarginine
  MISC_FEATURE (28)..(28): xaa=hydroxy proline
  MOD_RES (31)..(31): AMIDATION

SEQ ID NO: 229 - protein, 30 aa, Artificial Sequence; identical to SEQ ID NO: 6
  CGRP peptide
  MOD_RES (1)..(1): ACETYLATION
  MISC_FEATURE (18)..(18): PEGylated
  MOD_RES (30)..(30): AMIDATION

SEQ ID NO: 230 - protein, 30 aa, Artificial Sequence; identical to SEQ ID NO: 6
  CGRP peptide
  MOD_RES (1)..(1): ACETYLATION
  MISC_FEATURE (18)..(18): PEGylated
  MOD_RES (30)..(30): AMIDATION

SEQ ID NO: 231 - protein, 31 aa, Artificial Sequence
  CGRP peptide
  MOD_RES (1)..(1): ACETYLATION
  MISC_FEATURE (19)..(19): PEGylated
  MOD_RES (31)..(31): AMIDATION
WVTHRLAGLLSRSGGVVKCNFVPTDVGPFAF

SEQ ID NO: 232 - protein, 31 aa, Artificial Sequence; identical to SEQ ID NO: 231
  CGRP peptide
  MOD_RES (1)..(1): ACETYLATION
  MISC_FEATURE (19)..(19): PEGylated
  MOD_RES (31)..(31): AMIDATION

SEQ ID NO: 233 - protein, 31 aa, Artificial Sequence; identical to SEQ ID NO: 130
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=2-aminoindane-2-carboxylic acid
  MOD_RES (31)..(31): AMIDATION

SEQ ID NO: 234 - protein, 31 aa, Artificial Sequence; identical to SEQ ID NO: 130
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=2-aminoindane-2-carboxylic acid
  MOD_RES (31)..(31): AMIDATION

SEQ ID NO: 235 - protein, 31 aa, Artificial Sequence; identical to SEQ ID NO: 130
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=aminoisobutyric acid
  MOD_RES (31)..(31): AMIDATION

SEQ ID NO: 236 - protein, 31 aa, Artificial Sequence; identical to SEQ ID NO: 130
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Thiazolidine-4-carboxylic acid
  MOD_RES (31)..(31): AMIDATION

SEQ ID NO: 237 - protein, 31 aa, Artificial Sequence; identical to SEQ ID NO: 130
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Sarcosine
  MOD_RES (31)..(31): AMIDATION

SEQ ID NO: 238 - protein, 31 aa, Artificial Sequence; identical to SEQ ID NO: 130
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Sarcosine
  MOD_RES (31)..(31): AMIDATION

SEQ ID NO: 239 - protein, 31 aa, Artificial Sequence; identical to SEQ ID NO: 130
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=1,2,3,4-Tetrahydronorharman-3-Carboxylic acid
  MOD_RES (31)..(31): AMIDATION

SEQ ID NO: 240 - protein, 31 aa, Artificial Sequence; identical to SEQ ID NO: 130
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=pipecolic acid
  MOD_RES (31)..(31): AMIDATION

SEQ ID NO: 241 - protein, 31 aa, Artificial Sequence; identical to SEQ ID NO: 130
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=hydroxy proline
  MOD_RES (31)..(31): AMIDATION

SEQ ID NO: 242 - skipped

SEQ ID NO: 243 - protein, 31 aa, Artificial Sequence; identical to SEQ ID NO: 183
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=pipecolic acid
  MOD_RES (31)..(31): AMIDATION

SEQ ID NO: 244 - protein, 31 aa, Artificial Sequence; identical to SEQ ID NO: 183
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=hydroxy proline
  MOD_RES (31)..(31): AMIDATION

SEQ ID NO: 245 - skipped

SEQ ID NO: 246 - protein, 31 aa, Artificial Sequence; identical to SEQ ID NO: 183
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=2-aminoindane-2-carboxylic acid
  MOD_RES (31)..(31): AMIDATION

SEQ ID NO: 247 - skipped

SEQ ID NO: 248 - protein, 31 aa, Artificial Sequence; identical to SEQ ID NO: 183
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=aminoisobutyric acid
  MOD_RES (31)..(31): AMIDATION

SEQ ID NO: 249 - protein, 31 aa, Artificial Sequence; identical to SEQ ID NO: 183
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=Thiazolidine-4-carboxylic acid
  MOD_RES (31)..(31): AMIDATION

SEQ ID NO: 250 - protein, 31 aa, Artificial Sequence; identical to SEQ ID NO: 183
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=Sarcosine
  MOD_RES (31)..(31): AMIDATION

SEQ ID NO: 251 - protein, 31 aa, Artificial Sequence; identical to SEQ ID NO: 183
  CGRP peptide
  MISC_FEATURE: Lactam bridge between residues 3 and 7
  MOD_RES (1)..(1): ACETYLATION
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=Sarcosine
  MOD_RES (31)..(31): AMIDATION

SEQ ID NO: 252 - protein, 31 aa, Artificial Sequence; identical to SEQ ID NO: 183
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=1,2,3,4-Tetrahydronorharman-3-Carboxylic acid
  MOD_RES (31)..(31): AMIDATION

SEQ ID NO: 253 - skipped

SEQ ID NO: 254 - protein, 31 aa, Artificial Sequence; identical to SEQ ID NO: 183
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=pipecolic acid
  MOD_RES (31)..(31): AMIDATION

SEQ ID NO: 255 - skipped

SEQ ID NO: 256 - protein, 31 aa, Artificial Sequence
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=Octahydroindole-2-Carboxylic Acid
  MISC_FEATURE (31)..(31): xaa=3-(1-naphthyl)alanine
  MOD_RES (31)..(31): AMIDATION
WVEHRLKGLLSXSGGVVXKNFVPXDVGXFAX

SEQ ID NO: 257 - protein, 31 aa, Artificial Sequence
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=pipecolic acid
  MOD_RES (31)..(31): AMIDATION
WVEHRLKGLLSXSGGVVXKNFVPXDVGXFAY

SEQ ID NO: 258 - protein, 31 aa, Artificial Sequence
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=hydroxy proline
  MOD_RES (31)..(31): AMIDATION
WVEHRLKGLLSXSGGVVXKNFVPXDVGXFAH

SEQ ID NO: 259 - protein, 31 aa, Artificial Sequence; identical to SEQ ID NO: 256
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=hydroxy proline
  MISC_FEATURE (31)..(31): xaa=4,4'-biphenyl alanine
  MOD_RES (31)..(31): AMIDATION

SEQ ID NO: 260 - protein, 31 aa, Artificial Sequence; identical to SEQ ID NO: 256
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=2-aminoindane-2-carboxylic acid
  MISC_FEATURE (31)..(31): xaa=3-(2-naphthyl)alanine
  MOD_RES (31)..(31): AMIDATION

SEQ ID NO: 261 - protein, 31 aa, Artificial Sequence
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=2-aminoindane-2-carboxylic acid
  MOD_RES (31)..(31): AMIDATION
WVEHRLKGLLSXSGGVVXKNFVPXDVGXFAW

SEQ ID NO: 262 - protein, 31 aa, Artificial Sequence
  CGRP peptide
  MISC_FEATURE: Lactam bridge between residues 1 and 5.
  MOD_RES (1)..(1): ACETYLATION
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION
EVTHKLAGLLSXSGGVVXKNFVPTDVGXFAF

SEQ ID NO: 263 - protein, 31 aa, Artificial Sequence
  CGRP peptide
  MISC_FEATURE: Lactam bridge between residues 2 and 6.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION
WETHXKAGLLSXSGGVVXKNFVPTDVGXFAF

SEQ ID NO: 264 - protein, 31 aa, Artificial Sequence; identical to SEQ ID NO: 180
  CGRP peptide
  MISC_FEATURE: Lactam bridge between residues 3 and 7.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION

SEQ ID NO: 265 - protein, 31 aa, Artificial Sequence
  CGRP peptide
  MISC_FEATURE: Lactam bridge between residues 4 and 8.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION
WVTEXLAKLLSXSGGVVXKNFVPTDVGXFAF

SEQ ID NO: 266 - protein, 31 aa, Artificial Sequence
  CGRP peptide
  MISC_FEATURE: Lactam bridge between residues 5 and 9.
  MOD_RES (1)..(1): ACETYLATION
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION
WVTHELAGKLSXSGGVVXKNFVPTDVGXFAF

SEQ ID NO: 267 - protein, 31 aa, Artificial Sequence
  CGRP peptide
  MISC_FEATURE: Lactam bridge between residues 6 and 10.
  MOD_RES (1)..(1): AMIDATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION
WVTHXEAGLKSXSGGVVXKNFVPTDVGXFAF

SEQ ID NO: 268 - protein, 31 aa, Artificial Sequence
  CGRP peptide
  MISC_FEATURE: Lactam bridge between residues 7 and 11.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION
WVTHXLEGLLKXSGGVVXKNFVPTDVGXFAF

SEQ ID NO: 269 - protein, 31 aa, Artificial Sequence
  CGRP peptide
  MISC_FEATURE: Lactam bridge between residues 8 and 12.
  MOD_RES (1)..(1): AMIDATION
  MISC_FEATURE (5)..(5): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION
WVTHXLAELLSKSGGVVXKNFVPTDVGXFAF

SEQ ID NO: 270 - protein, 31 aa, Artificial Sequence; identical to SEQ ID NO: 129
  CGRP peptide
  MISC_FEATURE: Lactam bridge between residues 9 and 13.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION

SEQ ID NO: 271 - protein, 31 aa, Artificial Sequence
  CGRP peptide
  MISC_FEATURE: Lactam bridge between residues 10 and 14.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION
WVTHXLAGLESXSKGVVXKNFVPTDVGXFAF

SEQ ID NO: 272 - protein, 31 aa, Artificial Sequence
  CGRP peptide
  MISC_FEATURE: Lactam bridge between residues 11 and 15.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION
WVTHXLAGLLEXSGKVVXKNFVPTDVGXFAF

SEQ ID NO: 273 - protein, 31 aa, Artificial Sequence
  CGRP peptide
  MISC_FEATURE: Lactam bridge between residues 12 and 16.
  MOD_RES (1)..(1): ACETYLATION
  MISC_FEATURE (5)..(5): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION
WVTHXLAGLLSESGGKVXKNFVPTDVGXFAF

SEQ ID NO: 274 - protein, 31 aa, Artificial Sequence
  CGRP peptide
  MISC_FEATURE: Lactam bridge between residues 13 and 17.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION
WVTHXLAGLLSXEGGVKXKNFVPTDVGXFAF

SEQ ID NO: 275 - protein, 31 aa, Artificial Sequence
  CGRP peptide
  MISC_FEATURE: Lactam bridge between residues 20 and 25.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION
WVTHXLAGLLSXSGGVVXKKFVPTDVGXFAF

SEQ ID NO: 276 - protein, 31 aa, Artificial Sequence
  CGRP peptide
  MISC_FEATURE: Lactam bridge between residues 21 and 26.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION
WVTHXLAGLLSXSGGVVXKNKVPTDDGXFAF

SEQ ID NO: 277 - protein, 31 aa, Artificial Sequence
  CGRP peptide
  MISC_FEATURE: Lactam bridge between residues 22 and 27.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION
WVTHXLAGLLSXSGGVVXKNFKPTDVDXFAF

SEQ ID NO: 278 - protein, 31 aa, Artificial Sequence
  CGRP peptide
  MISC_FEATURE: Lactam bridge between residues 24 and 29.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION
WVTHXLAGLLSXSGGVVXKNFVPKDVGXDAF

SEQ ID NO: 279 - protein, 31 aa, Artificial Sequence
  CGRP peptide
  MISC_FEATURE: Lactam bridge between residues 25 and 30.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION
WVTHXLAGLLSXSGGVVXKNFVPTKVGXFDF

SEQ ID NO: 280 - protein, 31 aa, Artificial Sequence
  CGRP peptide
  MISC_FEATURE: Lactam bridge between residues 26 and 31.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION
WVTHXLAGLLSXSGGVVXKNFVPTDKGXFAD

SEQ ID NO: 281 - protein, 31 aa, Artificial Sequence; identical to SEQ ID NO: 130
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=beta-homo proline
  MOD_RES (31)..(31): AMIDATION

SEQ ID NO: 282 - protein, 31 aa, Artificial Sequence; identical to SEQ ID NO: 130
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=beta-homoarginine
  MISC_FEATURE (28)..(28): xaa=Octahydroindole-2-Carboxylic Acid
  MOD_RES (31)..(31): AMIDATION

SEQ ID NO: 283 - protein, 31 aa, Artificial Sequence
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MISC_FEATURE (29)..(29): xaa=beta-homo phenylalanine
  MOD_RES (31)..(31): AMIDATION
WVTHXLAGLLSXSGGVVXKNFVPTDVGXXAF

SEQ ID NO: 284 - protein, 31 aa, Artificial Sequence; identical to SEQ ID NO: 137
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (21)..(21): xaa=beta-homo phenylalanine
  MISC_FEATURE (28)..(28): xaa=Octahydroindole-2-Carboxylic Acid
  MOD_RES (31)..(31): AMIDATION

SEQ ID NO: 285 - protein, 31 aa, Artificial Sequence; identical to SEQ ID NO: 137
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (21)..(21): xaa=alpha-methyl phenyalanine
  MISC_FEATURE (28)..(28): xaa=Octahydroindole-2-Carboxylic Acid
  MOD_RES (31)..(31): AMIDATION

SEQ ID NO: 286 - protein, 31 aa, Artificial Sequence
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MISC_FEATURE (31)..(31): xaa=alpha-methyl phenyalanine
  MOD_RES (31)..(31): AMIDATION
WVTHXLAGLLSXSGGVVXKNFVPTDVGXFAX

SEQ ID NO: 287 - protein, 31 aa, Artificial Sequence; identical to SEQ ID NO: 283
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MISC_FEATURE (29)..(29): xaa=alpha-methyl phenyalanine
  MOD_RES (31)..(31): AMIDATION

SEQ ID NO: 288 - protein, 31 aa, Artificial Sequence; identical to SEQ ID NO: 137
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (21)..(21): xaa=Nalpha-methyl phenylaline
  MISC_FEATURE (28)..(28): xaa=Octahydroindole-2-Carboxylic Acid
  MOD_RES (31)..(31): AMIDATION

SEQ ID NO: 289 - protein, 31 aa, Artificial Sequence; identical to SEQ ID NO: 286
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MISC_FEATURE (31)..(31): xaa=Nalpha-methyl phenylaline
  MOD_RES (31)..(31): AMIDATION

SEQ ID NO: 290 - protein, 31 aa, Artificial Sequence; identical to SEQ ID NO: 283
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MISC_FEATURE (29)..(29): xaa=Nalpha-methyl phenylaline
  MOD_RES (31)..(31): AMIDATION

SEQ ID NO: 291 - protein, 31 aa, Artificial Sequence; identical to SEQ ID NO: 130
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Nipecotic Acid
  MOD_RES (31)..(31): AMIDATION

SEQ ID NO: 292-296 - skipped (5 entries)

SEQ ID NO: 297 - protein, 31 aa, Artificial Sequence; identical to SEQ ID NO: 130
  CGRP peptide
  MOD_RES (1)..(1): AMIDATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=1,2,3,4-L-Tetrahydroisoquinoline-3-Carboxylic acid
  MOD_RES (31)..(31): AMIDATION

SEQ ID NO: 298 - protein, 31 aa, Artificial Sequence; identical to SEQ ID NO: 131
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (29)..(29): xaa=1,2,3,4-L-Tetrahydroisoquinoline-3-Carboxylic acid
  MOD_RES (31)..(31): AMIDATION

SEQ ID NO: 299 - protein, 31 aa, Artificial Sequence; identical to SEQ ID NO: 132
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (23)..(23): xaa=Octahydroindole-2-Carboxylic Acid
  MISC_FEATURE (28)..(28): xaa=Octahydroindole-2-Carboxylic Acid
  MISC_FEATURE (31)..(31): xaa=3-(2-naphthyl)alanine
  MOD_RES (31)..(31): AMIDATION

SEQ ID NO: 300 - protein, 31 aa, Artificial Sequence; identical to SEQ ID NO: 133
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (23)..(23): xaa=Octahydroindole-2-Carboxylic Acid
  MISC_FEATURE (29)..(29): xaa=3-(1-naphthyl)alanine
  MISC_FEATURE (31)..(31): xaa=3-(2-naphthyl)alanine
  MOD_RES (31)..(31): AMIDATION

SEQ ID NO: 301 - protein, 31 aa, Artificial Sequence; identical to SEQ ID NO: 134
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (23)..(23): xaa=Octahydroindole-2-Carboxylic Acid
  MISC_FEATURE (29)..(29): xaa=4,4'-biphenyl alanine
  MOD_RES (31)..(31): AMIDATION

SEQ ID NO: 302 - protein, 31 aa, Artificial Sequence; identical to SEQ ID NO: 135
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (23)..(23): xaa=Octahydroindole-2-Carboxylic Acid
  MISC_FEATURE (31)..(31): xaa=3-(2-naphthyl)alanine
  MOD_RES (31)..(31): AMIDATION

SEQ ID NO: 303 - protein, 31 aa, Artificial Sequence; identical to SEQ ID NO: 136
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (21)..(21): xaa=4-iodophenylalanine
  MISC_FEATURE (23)..(23): xaa=Octahydroindole-2-Carboxylic Acid
  MISC_FEATURE (29)..(29): xaa=4-iodophenylalanine
  MOD_RES (31)..(31): AMIDATION

SEQ ID NO: 304 - protein, 31 aa, Artificial Sequence; identical to SEQ ID NO: 137
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (21)..(21): xaa=3-(2-naphthyl)alanine
  MISC_FEATURE (28)..(28): xaa=Octahydroindole-2-Carboxylic Acid
  MOD_RES (31)..(31): AMIDATION

SEQ ID NO: 305 - protein, 31 aa, Artificial Sequence; identical to SEQ ID NO: 138
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (21)..(21): xaa=3-(2-naphthyl)alanine
  MISC_FEATURE (28)..(28): xaa=Octahydroindole-2-Carboxylic Acid
  MISC_FEATURE (31)..(31): xaa=3-(2-naphthyl)alanine
  MOD_RES (31)..(31): AMIDATION

SEQ ID NO: 306 - protein, 31 aa, Artificial Sequence; identical to SEQ ID NO: 139
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (21)..(21): xaa=3-(2-naphthyl)alanine
  MISC_FEATURE (23)..(23): xaa=Octahydroindole-2-Carboxylic Acid
  MISC_FEATURE (28)..(28): xaa=Octahydroindole-2-Carboxylic Acid
  MISC_FEATURE (31)..(31): xaa=3-(2-naphthyl)alanine
  MOD_RES (31)..(31): AMIDATION

SEQ ID NO: 307 - protein, 31 aa, Artificial Sequence; identical to SEQ ID NO: 140
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (28)..(28): xaa=1,2,3,4-L-Tetrahydroisoquinoline-3-Carboxylic acid
  MOD_RES (31)..(31): AMIDATION

SEQ ID NO: 308 - protein, 31 aa, Artificial Sequence; identical to SEQ ID NO: 140
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (28)..(28): xaa=1,2,3,4-L-Tetrahydroisoquinoline-3-Carboxylic acid
  MOD_RES (31)..(31): AMIDATION

SEQ ID NO: 309 - protein, 31 aa, Artificial Sequence; identical to SEQ ID NO: 130
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=1,2,3,4-L-Tetrahydroisoquinoline-3-Carboxylic acid
  MOD_RES (31)..(31): AMIDATION

SEQ ID NO: 310 - protein, 31 aa, Artificial Sequence; identical to SEQ ID NO: 130
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=1,2,3,4-L-Tetrahydroisoquinoline-3-Carboxylic acid
  MOD_RES (31)..(31): AMIDATION

SEQ ID NO: 311 - protein, 31 aa, Artificial Sequence; identical to SEQ ID NO: 131
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (29)..(29): xaa=3-(1-naphthyl)alanine
  MOD_RES (31)..(31): AMIDATION

SEQ ID NO: 312 - protein, 31 aa, Artificial Sequence; identical to SEQ ID NO: 130
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION

SEQ ID NO: 313 - protein, 31 aa, Artificial Sequence; identical to SEQ ID NO: 146
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (29)..(29): xaa=1,2,3,4-L-Tetrahydroisoquinoline-3-Carboxylic acid
  MOD_RES (31)..(31): AMIDATION

SEQ ID NO: 314 - protein, 31 aa, Artificial Sequence; identical to SEQ ID NO: 130
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=1,2,3,4-L-Tetrahydroisoquinoline-3-Carboxylic acid
  MOD_RES (31)..(31): AMIDATION

SEQ ID NO: 315 - protein, 31 aa, Artificial Sequence; identical to SEQ ID NO: 131
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (29)..(29): xaa=1,2,3,4-L-Tetrahydroisoquinoline-3-Carboxylic acid
  MOD_RES (31)..(31): AMIDATION

SEQ ID NO: 316 - protein, 31 aa, Artificial Sequence; identical to SEQ ID NO: 132
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (23)..(23): xaa=Octahydroindole-2-Carboxylic Acid
  MISC_FEATURE (28)..(28): xaa=Octahydroindole-2-Carboxylic Acid
  MISC_FEATURE (31)..(31): xaa=3-(2-naphthyl)alanine
  MOD_RES (31)..(31): AMIDATION

SEQ ID NO: 317 - protein, 31 aa, Artificial Sequence; identical to SEQ ID NO: 133
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (23)..(23): xaa=Octahydroindole-2-Carboxylic Acid
  MISC_FEATURE (29)..(29): xaa=3-(1-naphthyl)alanine
  MISC_FEATURE (31)..(31): xaa=3-(2-naphthyl)alanine
  MOD_RES (31)..(31): AMIDATION

SEQ ID NO: 318 - protein, 31 aa, Artificial Sequence; identical to SEQ ID NO: 134
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (23)..(23): xaa=Octahydroindole-2-Carboxylic Acid
  MISC_FEATURE (29)..(29): xaa=4,4'-biphenyl alanine
  MOD_RES (31)..(31): AMIDATION

SEQ ID NO: 319 - protein, 31 aa, Artificial Sequence
  CGRP peptide
  MOD_RES (1)..(1): ACETYLATION
  MISC_FEATURE (21)..(21): xaa=3-(2-naphthyl)alanine
  MOD_RES (31)..(31): AMIDATION
WVTHRLAGLLSRSGGVVRKNXVPTDVGPFAF

SEQ ID NO: 320 - protein, 31 aa, Artificial Sequence
  CGRP peptide
  MOD_RES (1)..(1): ACETYLATION
  MISC_FEATURE (31)..(31): xaa=3-(2-naphthyl)alanine
  MOD_RES (31)..(31): AMIDATION
WVTHRLAGLLSRSGGVVRKNFVPTDVGPFAX

SEQ ID NO: 321 - protein, 31 aa, Artificial Sequence; identical to SEQ ID NO: 320
  CGRP peptide
  MOD_RES (1)..(1): ACETYLATION
  MISC_FEATURE (31)..(31): xaa=3-(1-naphthyl)alanine
  MOD_RES (31)..(31): AMIDATION

SEQ ID NO: 322 - protein, 31 aa, Artificial Sequence
  CGRP peptide
  MOD_RES (1)..(1): ACETYLATION
  MOD_RES (31)..(31): AMIDATION
WVTHRLAGLLSRSGGVVRKNFVPTDVGSKAF

SEQ ID NO: 323 - protein, 33 aa, Artificial Sequence
  CGRP peptide
  MISC_FEATURE (2)..(2): xaa=6-aminohexanoic acid
  MOD_RES (33)..(33): AMIDATION
CXWVTHRLAGLLSRSGGVVRKNFVPTDVGPFAF

SEQ ID NO: 324 - protein, 31 aa, Artificial Sequence
  CGRP peptide
  MOD_RES (1)..(1): ACETYLATION
  MOD_RES (31)..(31): AMIDATION
WVTHRLAGLLSRSGGVVRKNFVPTDVGPKAF

SEQ ID NO: 325 - protein, 31 aa, Artificial Sequence
  CGRP peptide
  MOD_RES (1)..(1): ACETYLATION
  MISC_FEATURE (5)..(5): xaa=citrulline
  MISC_FEATURE (12)..(12): xaa=citrulline
  MOD_RES (31)..(31): AMIDATION
WVTHXLAGLLSXSGGVVRKNFVPTDVGPKAF

SEQ ID NO: 326 - protein, 31 aa, Artificial Sequence
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (23)..(23): xaa=Octahydroindole-2-Carboxylic Acid
  MOD_RES (31)..(31): AMIDATION
WVTHXLAGLLSXSGGVVRKNFVXTDVGPFAF

SEQ ID NO: 327 - protein, 31 aa, Artificial Sequence; identical to SEQ ID NO: 140
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (28)..(28): xaa=Octahydroindole-2-Carboxylic Acid
  MOD_RES (31)..(31): AMIDATION

SEQ ID NO: 328 - protein, 31 aa, Artificial Sequence
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (23)..(23): xaa=Octahydroindole-2-Carboxylic Acid
  MISC_FEATURE (28)..(28): xaa=Octahydroindole-2-Carboxylic Acid
  MOD_RES (31)..(31): AMIDATION
WVTHXLAGLLSXSGGVVRKNFVXTDVGXFAF

SEQ ID NO: 329 - protein, 31 aa, Artificial Sequence
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (21)..(21): xaa=4-iodophenylalanine
  MISC_FEATURE (31)..(31): xaa=4-iodophenylalanine
  MOD_RES (31)..(31): AMIDATION
WVTHXLAGLLSXSGGVVRKNXVPTDVGPFAX

SEQ ID NO: 330 - protein, 31 aa, Artificial Sequence
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (31)..(31): xaa=4-iodophenylalanine
  MOD_RES (31)..(31): AMIDATION
WVTHXLAGLLSXSGGVVRKNFVPTDVGPFAX

SEQ ID NO: 331 - protein, 31 aa, Artificial Sequence; identical to SEQ ID NO: 131
  CGRP peptide
  MOD_RES (1)..(1): ACETYLATION
  MISC_FEATURE (5)..(5): xaa=homoarginine
  MISC_FEATURE (12)..(12): xaa=citrulline
  MISC_FEATURE (18)..(18): xaa=homoarginine
  MISC_FEATURE (29)..(29): xaa=3-(1-naphthyl)alanine
  MOD_RES (31)..(31): AMIDATION

SEQ ID NO: 332 - protein, 31 aa, Artificial Sequence
  CGRP peptide
  MOD_RES (1)..(1): ACETYLATION
  MISC_FEATURE (5)..(5): xaa=homoarginine
  MISC_FEATURE (12)..(12): xaa=citrulline
  MISC_FEATURE (18)..(18): xaa=homoarginine
  MISC_FEATURE (31)..(31): xaa=phenylglycine
  MOD_RES (31)..(31): AMIDATION
WVTHXLAGLLSXSGGVVXKNFVPTDVGPFAX

SEQ ID NO: 333 - protein, 31 aa, Artificial Sequence; identical to SEQ ID NO: 131
  CGRP peptide
  MOD_RES (1)..(1): ACETYLATION
  MISC_FEATURE (5)..(5): xaa=homoarginine
  MISC_FEATURE (12)..(12): xaa=citrulline
  MISC_FEATURE (18)..(18): xaa=homoarginine
  MISC_FEATURE (29)..(29): xaa=3-(2-naphthyl)alanine
  MOD_RES (31)..(31): AMIDATION

SEQ ID NO: 334 - protein, 31 aa, Artificial Sequence; identical to SEQ ID NO: 131
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (29)..(29): xaa=3-(1-naphthyl)alanine
  MOD_RES (31)..(31): AMIDATION

SEQ ID NO: 335 - protein, 31 aa, Artificial Sequence; identical to SEQ ID NO: 178
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (21)..(21): xaa=4-iodophenylalanine
  MISC_FEATURE (29)..(29): xaa=4-iodophenylalanine
  MOD_RES (31)..(31): AMIDATION

SEQ ID NO: 336 - protein, 31 aa, Artificial Sequence; identical to SEQ ID NO: 131
  CGRP peptide
  MOD_RES (1)..(1): AMIDATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (29)..(29): xaa=4,4'-biphenyl alanine
  MOD_RES (31)..(31): AMIDATION

SEQ ID NO: 337 - protein, 31 aa, Artificial Sequence; identical to SEQ ID NO: 131
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (29)..(29): xaa=Indanyl glycine
  MOD_RES (31)..(31): AMIDATION

SEQ ID NO: 338 - protein, 31 aa, Artificial Sequence; identical to SEQ ID NO: 130
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION

SEQ ID NO: 339 - protein, 31 aa, Artificial Sequence
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (23)..(23): xaa=Octahydroindole-2-Carboxylic Acid
  MISC_FEATURE (28)..(28): xaa=Octahydroindole-2-Carboxylic Acid
  MOD_RES (31)..(31): AMIDATION
WVTHXLAGLLSXSGGVVXKNFVXTDVGXFAF

SEQ ID NO: 340 - protein, 31 aa, Artificial Sequence; identical to SEQ ID NO: 283
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MISC_FEATURE (29)..(29): xaa=3-(1-naphthyl)alanine
  MOD_RES (31)..(31): AMIDATION

SEQ ID NO: 341 - protein, 31 aa, Artificial Sequence; identical to SEQ ID NO: 283
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MISC_FEATURE (29)..(29): xaa=3-(2-naphthyl)alanine
  MOD_RES (31)..(31): AMIDATION

SEQ ID NO: 342 - protein, 31 aa, Artificial Sequence; identical to SEQ ID NO: 71
  CGRP peptide
  MISC_FEATURE (5)..(5): xaa=citrulline
  MISC_FEATURE (12)..(12): xaa=homoarginine
  MISC_FEATURE (18)..(18): xaa=4-guanidinyl phenylalanine

SEQ ID NO: 343 - protein, 31 aa, Artificial Sequence; identical to SEQ ID NO: 71
  CGRP peptide
  MOD_RES (1)..(1): ACETYLATION
  MISC_FEATURE (5)..(5): xaa=citrulline
  MISC_FEATURE (12)..(12): xaa=homoarginine
  MISC_FEATURE (18)..(18): xaa=beta-homoarginine
  MOD_RES (31)..(31): AMIDATION

SEQ ID NO: 344 - protein, 31 aa, Artificial Sequence; identical to SEQ ID NO: 71
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=citrulline
  MOD_RES (31)..(31): AMIDATION

SEQ ID NO: 345 - protein, 31 aa, Artificial Sequence; identical to SEQ ID NO: 71
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=2-amino-3-guanidinopropanoic acid
  MOD_RES (31)..(31): AMIDATION

SEQ ID NO: 346 - protein, 31 aa, Artificial Sequence; identical to SEQ ID NO: 71
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=4-guanidinyl phenylalanine
  MOD_RES (31)..(31): AMIDATION

SEQ ID NO: 347 - protein, 31 aa, Artificial Sequence
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (17)..(17): xaa=norleucine
  MOD_RES (31)..(31): AMIDATION
WVTHXLAGLLSXSGGVXRKNFVPTDVGPFAF

SEQ ID NO: 348 - protein, 31 aa, Artificial Sequence
  CGRP peptide
  MISC_FEATURE: Lactam bridge between residues 3 and 7.
  MOD_RES (1)..(1): ACETYLATION
  MISC_FEATURE (5)..(5): xaa=homoarginine
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION
WVCHXLCGLLSXSGGVVXKNFVPTDVGXFAF

SEQ ID NO: 349 - protein, 31 aa, Artificial Sequence
  CGRP peptide
  MISC_FEATURE: Lactam bridge between residues 3 and 7
  MOD_RES (1)..(1): ACETYLATION
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION
WVCHKLCGLLSXSGGVVXKNFVPTDVGXFAF

SEQ ID NO: 350 - protein, 31 aa, Artificial Sequence
  CGRP peptide
  MISC_FEATURE: Lactam bridge between residues 3 and 7
  MOD_RES (1)..(1): ACETYLATION
  MISC_FEATURE (5)..(5): xaa=homocitrulline
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
WVCHXLCGLLSXSGGVVXKNFVPXDVGXFAF

SEQ ID NO: 351 - protein, 31 aa, Artificial Sequence; identical to SEQ ID NO: 350
  CGRP peptide
  MISC_FEATURE: Lactam bridge between residues 3 and 7
  MOD_RES (1)..(1): ACETYLATION
  MISC_FEATURE (5)..(5): xaa=ornithine
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION

SEQ ID NO: 352 - protein, 31 aa, Artificial Sequence
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=Octahydroindole-2-Carboxylic Acid
  MISC_FEATURE (31)..(31): xaa=3-(2-naphthyl)alanine
  MOD_RES (31)..(31): AMIDATION
WVCHHLCGLLSXSGGVVXKNFVPXDVGXFAX

SEQ ID NO: 353 - protein, 31 aa, Artificial Sequence
  CGRP peptide
  MISC_FEATURE: Lactam bridge between residues 3 and 7
  MOD_RES (1)..(1): ACETYLATION
  MISC_FEATURE (5)..(5): xaa=homoarginine
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION
WVKHXLEGLLSXSGGVVXKNFVPTDVGXFAF

SEQ ID NO: 354 - protein, 31 aa, Artificial Sequence
  CGRP peptide
  MISC_FEATURE: Lactam bridge between residues 3 and 7
  MOD_RES (1)..(1): ACETYLATION
  MISC_FEATURE (12)..(12): xaa=citrulline
  MISC_FEATURE (18)..(18): xaa=chomoarginine
  MISC_FEATURE (28)..(28): xaa=Octahydroindole-2-Carboxylic Acid
  MOD_RES (31)..(31): AMIDATION
WVKHKLEGLLSXSGGVVXKNFVPTDVGXFAF

SEQ ID NO: 355 - protein, 31 aa, Artificial Sequence
  CGRP peptide
  MISC_FEATURE: Lactam bridge between residues 3 and 7
  MOD_RES (1)..(1): ACETYLATION
  MISC_FEATURE (5)..(5): xaa=homocitrulline
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
WVKHXLEGLLSXSGGVVXKNFVPXDVGXFAF

SEQ ID NO: 356 - protein, 31 aa, Artificial Sequence; identical to SEQ ID NO: 355
  CGRP peptide
  MISC_FEATURE: Lactam bridge between residues 3 and 7.
  MOD_RES (1)..(1): ACETYLATION
  MISC_FEATURE (5)..(5): xaa=ornithine
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION

SEQ ID NO: 357 - protein, 31 aa, Artificial Sequence
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=Octahydroindole-2-Carboxylic Acid
  MISC_FEATURE (31)..(31): xaa=3-(2-naphthyl)alanine
  MOD_RES (31)..(31): AMIDATION
WVKHHLEGLLSXSGGVVXKNFVPXDVGXFAX

SEQ ID NO: 358 - protein, 31 aa, Artificial Sequence
  CGRP peptide
  MISC_FEATURE: Lactam bridge between residues 3 and 7.
  MOD_RES (1)..(1): ACETYLATION
  MISC_FEATURE (5)..(5): xaa=homoarginine
  MISC_FEATURE (12)..(12): xaa=citrulline
  MISC_FEATURE (19)..(19): xaa=homoarginine
  MISC_FEATURE (28)..(28): xaa=Octahydroindole-2-Carboxylic Acid
  MOD_RES (31)..(31): AMIDATION
WVEHXLKGLLSXSGGVVKXNFVPTDVGXFAF

SEQ ID NO: 359 - protein, 31 aa, Artificial Sequence
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (19)..(19): xaa=homoarginine
  MISC_FEATURE (28)..(28): xaa=Octahydroindole-2-Carboxylic Acid
  MOD_RES (31)..(31): AMIDATION
WVEHKLKGLLSXSGGVVKXNFVPTDVGXFAF

SEQ ID NO: 360 - protein, 31 aa, Artificial Sequence
  CGRP peptide
  MISC_FEATURE: Lactam bridge between residues 3 and 7
  MOD_RES (1)..(1): ACETYLATION
  MISC_FEATURE (5)..(5): xaa=homocitrulline
  MISC_FEATURE (12)..(12): xaa=citrulline
  MISC_FEATURE (19)..(19): xaa=homoarginine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
WVEHXLKGLLSXSGGVVKXNFVPXDVGXFAF

SEQ ID NO: 361 - protein, 31 aa, Artificial Sequence; identical to SEQ ID NO: 360
  CGRP peptide
  MISC_FEATURE: Lactam bridge between residues 3 and 7
  MOD_RES (1)..(1): ACETYLATION
  MISC_FEATURE (5)..(5): xaa=ornithine
  MISC_FEATURE (12)..(12): xaa=citrulline
  MISC_FEATURE (19)..(19): xaa=homoarginine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION

SEQ ID NO: 362 - protein, 31 aa, Artificial Sequence
  CGRP peptide
  MISC_FEATURE: Lactam bridge between residues 3 and 7
  MOD_RES (1)..(1): ACETYLATION
  MISC_FEATURE (12)..(12): xaa=citrulline
  MISC_FEATURE (19)..(19): xaa=homoarginine
  MISC_FEATURE (24)..(24): xaa=Nalpha-methyl threonine
  MISC_FEATURE (28)..(28): xaa=Octahydroindole-2-Carboxylic Acid
  MISC_FEATURE (31)..(31): xaa=3-(2-naphthyl)alanine
  MOD_RES (31)..(31): AMIDATION
WVEHHLKGLLSXSGGVVKXNFVPXDVGXFAX

SEQ ID NO: 363 - protein, 31 aa, Artificial Sequence
  CGRP peptide
  MISC_FEATURE: Lactam bridge between residues 3 and 7
  MOD_RES (1)..(1): ACETYLATION
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=Octahydroindole-2-Carboxylic Acid
  MISC_FEATURE (31)..(31): xaa=3-(1-naphthyl)alanine
  MOD_RES (31)..(31): AMIDATION
WVCHRLCGLLSXSGGVVXKNFVPXDVGXFAX

SEQ ID NO: 364 - protein, 31 aa, Artificial Sequence
  CGRP peptide
  MISC_FEATURE: Lactam bridge between residues 3 and 7
  MOD_RES (1)..(1): ACETYLATION
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=pipecolic acid
  MOD_RES (31)..(31): AMIDATION
WVCHRLCGLLSXSGGVVXKNFVPXDVGXFAY

SEQ ID NO: 365 - protein, 31 aa, Artificial Sequence
  CGRP peptide
  MISC_FEATURE: Lactam bridge between residues 3 and 7
  MOD_RES (1)..(1): ACETYLATION
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=hydroxy proline
  MOD_RES (31)..(31): AMIDATION
WVCHRLCGLLSXSGGVVXKNFVPXDVGXFAH

SEQ ID NO: 366 - protein, 31 aa, Artificial Sequence; identical to SEQ ID NO: 363
  CGRP peptide
  MISC_FEATURE: Lactam bridge between residues 3 and 7
  MOD_RES (1)..(1): ACETYLATION
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=hydroxy proline
  MISC_FEATURE (31)..(31): xaa=4,4'-biphenyl alanine
  MOD_RES (31)..(31): AMIDATION

SEQ ID NO: 367 - protein, 31 aa, Artificial Sequence; identical to SEQ ID NO: 363
  CGRP peptide
  MISC_FEATURE: Lactam bridge between residues 3 and 7
  MOD_RES (1)..(1): ACETYLATION
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=2-aminoindane-2-carboxylic acid
  MISC_FEATURE (31)..(31): xaa=3-(2-naphthyl)alanine
  MOD_RES (31)..(31): AMIDATION

SEQ ID NO: 368 - protein, 31 aa, Artificial Sequence
  CGRP peptide
  MISC_FEATURE: Lactam bridge between residues 3 and 7
  MOD_RES (1)..(1): ACETYLATION
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=2-aminoindane-2-carboxylic acid
  MOD_RES (31)..(31): AMIDATION
WVCHRLCGLLSXSGGVVXKNFVPXDVGXFAW

SEQ ID NO: 369 - protein, 31 aa, Artificial Sequence; identical to SEQ ID NO: 180
  CGRP peptide
  MISC_FEATURE: Lactam bridge between residues 3 and 7
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=Nalpha-methyl arginine
  MISC_FEATURE (28)..(28): xaa=Octahydroindole-2-Carboxylic Acid
  MOD_RES (31)..(31): AMIDATION

SEQ ID NO: 370 - protein, 31 aa, Artificial Sequence; identical to SEQ ID NO: 181
  CGRP peptide
  MISC_FEATURE: Lactam bridge between residues 3 and 7
  MOD_RES (1)..(1): ACETYLATION
  MISC_FEATURE (12)..(12): xaa=citrulline
  MISC_FEATURE (18)..(18): xaa=Nalpha-methyl arginine
  MISC_FEATURE (28)..(28): xaa=Octahydroindole-2-Carboxylic Acid
  MOD_RES (31)..(31): AMIDATION

SEQ ID NO: 371 - protein, 31 aa, Artificial Sequence; identical to SEQ ID NO: 182
  CGRP peptide
  MISC_FEATURE: Lactam bridge between residues 3 and 7.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=Nalpha-methyl arginine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION

SEQ ID NO: 372 - protein, 31 aa, Artificial Sequence; identical to SEQ ID NO: 183
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (18)..(18): xaa=Nalpha-methyl arginine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION

SEQ ID NO: 373 - protein, 31 aa, Artificial Sequence; identical to SEQ ID NO: 180
  CGRP peptide
  MISC_FEATURE: Lactam bridge between residues 3 and 7.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=Nalpha-methyl arginine
  MISC_FEATURE (28)..(28): xaa=Octahydroindole-2-Carboxylic Acid
  MOD_RES (31)..(31): AMIDATION

SEQ ID NO: 374 - protein, 31 aa, Artificial Sequence; identical to SEQ ID NO: 181
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (18)..(18): xaa=Nalpha-methyl arginine
  MISC_FEATURE (28)..(28): xaa=Octahydroindole-2-Carboxylic Acid
  MOD_RES (31)..(31): AMIDATION

SEQ ID NO: 375 - protein, 31 aa, Artificial Sequence; identical to SEQ ID NO: 182
  CGRP peptide
  MISC_FEATURE: Lactam bridge between residues 3 and 7.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=Nalpha-methyl arginine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION

SEQ ID NO: 376 - protein, 31 aa, Artificial Sequence; identical to SEQ ID NO: 183
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (18)..(18): xaa=Nalpha-methyl arginine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION

SEQ ID NO: 377 - protein, 31 aa, Artificial Sequence; identical to SEQ ID NO: 188
  CGRP peptide
  MISC_FEATURE: Lactam bridge between residues 3 and 7.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=Nalpha-methyl arginine
  MISC_FEATURE (24)..(24): xaa=Nalpha-methyl threonine
  MISC_FEATURE (28)..(28): xaa=Octahydroindole-2-Carboxylic Acid
  MISC_FEATURE (31)..(31): xaa=3-(2-naphthyl)alanine
  MOD_RES (31)..(31): AMIDATION

SEQ ID NO: 378 - protein, 31 aa, Artificial Sequence; identical to SEQ ID NO: 180
  CGRP peptide
  MISC_FEATURE: Lactam bridge between residues 3 and 7.
  MOD_RES (1)..(1): ACETYLATION
  MISC_FEATURE (5)..(5): xaa=Nalpha-methyl arginine
  MISC_FEATURE (12)..(12): xaa=citrulline
  MISC_FEATURE (18)..(18): xaa=Nalpha-methyl arginine
  MISC_FEATURE (28)..(28): xaa=Octahydroindole-2-Carboxylic Acid
  MOD_RES (31)..(31): AMIDATION

SEQ ID NO: 379 - protein, 31 aa, Artificial Sequence; identical to SEQ ID NO: 190
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (18)..(18): xaa=Nalpha-methyl arginine
  MISC_FEATURE (28)..(28): xaa=Octahydroindole-2-Carboxylic Acid
  MOD_RES (31)..(31): AMIDATION

SEQ ID NO: 380 - protein, 31 aa, Artificial Sequence; identical to SEQ ID NO: 182
  CGRP peptide
  MISC_FEATURE: Lactam bridge between residues 3 and 7.
  MOD_RES (1)..(1): ACETYLATION
  MISC_FEATURE (5)..(5): xaa=homocitrulline
  MISC_FEATURE (12)..(12): xaa=citrulline
  MISC_FEATURE (18)..(18): xaa=Nalpha-methyl arginine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION

SEQ ID NO: 381 - protein, 31 aa, Artificial Sequence; identical to SEQ ID NO: 182
  CGRP peptide
  MISC_FEATURE: Lactam bridge between residues 3 and 7.
  MOD_RES (1)..(1): ACETYLATION
  MISC_FEATURE (5)..(5): xaa=ornithine
  MISC_FEATURE (12)..(12): xaa=citrulline
  MISC_FEATURE (18)..(18): xaa=Nalpha-methyl arginine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION

SEQ ID NO: 382 - protein, 31 aa, Artificial Sequence; identical to SEQ ID NO: 193
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (18)..(18): xaa=Nalpha-methyl arginine
  MISC_FEATURE (24)..(24): xaa=Nalpha-methyl threonine
  MISC_FEATURE (28)..(28): xaa=Octahydroindole-2-Carboxylic Acid
  MISC_FEATURE (31)..(31): xaa=3-(2-naphthyl)alanine
  MOD_RES (31)..(31): AMIDATION

SEQ ID NO: 383 - protein, 31 aa, Artificial Sequence; identical to SEQ ID NO: 194
  CGRP peptide
  MISC_FEATURE: Lactam bridge between residues 3 and 7.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=Nalpha-methyl arginine
  MISC_FEATURE (28)..(28): xaa=Octahydroindole-2-Carboxylic Acid
  MOD_RES (31)..(31): AMIDATION

SEQ ID NO: 384 - protein, 31 aa, Artificial Sequence; identical to SEQ ID NO: 195
  CGRP peptide
  MISC_FEATURE: Lactam bridge between residues 3 and 7
  MOD_RES (1)..(1): ACETYLATION
  MISC_FEATURE (12)..(12): xaa=citrulline
  MISC_FEATURE (18)..(18): xaa=Nalpha-methyl arginine
  MISC_FEATURE (28)..(28): xaa=Octahydroindole-2-Carboxylic Acid
  MOD_RES (31)..(31): AMIDATION

SEQ ID NO: 385 - protein, 31 aa, Artificial Sequence; identical to SEQ ID NO: 196
  CGRP peptide
  MISC_FEATURE: Lactam bridge between residues 3 and 7
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=Nalpha-methyl arginine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION

SEQ ID NO: 386 - protein, 31 aa, Artificial Sequence; identical to SEQ ID NO: 197
  CGRP peptide
  MISC_FEATURE: Lactam bridge between residues 3 and 7
  MOD_RES (1)..(1): ACETYLATION
  MISC_FEATURE (12)..(12): xaa=citrulline
  MISC_FEATURE (18)..(18): xaa=Nalpha-methyl arginine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION

SEQ ID NO: 387 - protein, 31 aa, Artificial Sequence; identical to SEQ ID NO: 198
  CGRP peptide
  MISC_FEATURE: Lactam bridge between residues 3 and 7
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=Nalpha-methyl arginine
  MISC_FEATURE (24)..(24): xaa=Nalpha-methyl threonine
  MISC_FEATURE (28)..(28): xaa=Octahydroindole-2-Carboxylic Acid
  MISC_FEATURE (31)..(31): xaa=3-(2-naphthyl)alanine
  MOD_RES (31)..(31): AMIDATION

SEQ ID NO: 388 - protein, 31 aa, Artificial Sequence
  CGRP peptide
  MISC_FEATURE: Lactam bridge between residues 3 and 7
  MOD_RES (1)..(1): ACETYLATION
  MISC_FEATURE (5)..(5): xaa=citrulline
  MISC_FEATURE (12)..(12): xaa=citrulline
  MISC_FEATURE (28)..(28): xaa=Octahydroindole-2-Carboxylic Acid
  MOD_RES (31)..(31): AMIDATION
WVEHXLKGLLSXSGGVVRKNFVPTDVGXFAF

SEQ ID NO: 389 - protein, 31 aa, Artificial Sequence
  CGRP peptide
  MISC_FEATURE: Lactam bridge between residues 3 and 7
  MOD_RES (1)..(1): ACETYLATION
  MISC_FEATURE (12)..(12): xaa=citrulline
  MISC_FEATURE (28)..(28): xaa=Octahydroindole-2-Carboxylic Acid
  MOD_RES (31)..(31): AMIDATION
WVEHRLKGLLSXSGGVVRKNFVPTDVGXFAF

SEQ ID NO: 390 - protein, 31 aa, Artificial Sequence
  CGRP peptide
  MISC_FEATURE: Lactam bridge between residues 3 and 7
  MOD_RES (1)..(1): ACETYLATION
  MISC_FEATURE (5)..(5): xaa=citrulline
  MISC_FEATURE (12)..(12): xaa=citrulline
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
WVEHXLKGLLSXSGGVVRKNFVPXDVGXFAF

SEQ ID NO: 391 - protein, 31 aa, Artificial Sequence
  CGRP peptide
  MISC_FEATURE: Lactam bridge between residues 3 and 7
  MOD_RES (1)..(1): ACETYLATION
  MISC_FEATURE (12)..(12): xaa=citrulline
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
WVEHRLKGLLSXSGGVVRKNFVPXDVGXFAF

SEQ ID NO: 392 - skipped

SEQ ID NO: 393 - protein, 31 aa, Artificial Sequence; identical to SEQ ID NO: 389
  CGRP peptide
  MISC_FEATURE: Lactam bridge between residues 3 and 7
  MOD_RES (1)..(1): ACETYLATION
  MISC_FEATURE (12)..(12): xaa=citrulline
  MISC_FEATURE (28)..(28): xaa=Octahydroindole-2-Carboxylic Acid
  MOD_RES (31)..(31): AMIDATION

SEQ ID NO: 394 - skipped

SEQ ID NO: 395 - protein, 31 aa, Artificial Sequence; identical to SEQ ID NO: 391
  CGRP peptide
  MISC_FEATURE: lactam bridge between residues 3 and 7
  MOD_RES (1)..(1): ACETYLATION
  MISC_FEATURE (12)..(12): xaa=citrulline
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION

SEQ ID NO: 396 - protein, 31 aa, Artificial Sequence
  CGRP peptide
  MISC_FEATURE: Lactam bridge between residues 3 and 7
  MOD_RES (1)..(1): ACETYLATION
  MISC_FEATURE (5)..(5): xaa=citrulline
  MISC_FEATURE (12)..(12): xaa=citrulline
  MISC_FEATURE (24)..(24): xaa=Nalpha-methyl threonine
  misc_feature (28)..(28): Xaa can be any naturally occurring amino acid
  MISC_FEATURE (31)..(31): xaa=3-(2-naphthyl)alanine
  MOD_RES (31)..(31): AMIDATION
WVEHXLKGLLSXSGGVVRKNFVPXDVGXFAX

SEQ ID NO: 397 - protein, 31 aa, Artificial Sequence; identical to SEQ ID NO: 389
  CGRP peptide
  MISC_FEATURE: Lactam bridge between residues 3 and 7
  MOD_RES (1)..(1): ACETYLATION
  MISC_FEATURE (12)..(12): xaa=citrulline
  MISC_FEATURE (28)..(28): xaa=Octahydroindole-2-Carboxylic Acid
  MOD_RES (31)..(31): AMIDATION

SEQ ID NO: 398 - protein, 31 aa, Artificial Sequence
  CGRP peptide
  MISC_FEATURE: Lactam bridge between residues 3 and 7
  MOD_RES (1)..(1): ACETYLATION
  MISC_FEATURE (12)..(12): xaa=citrulline
  MISC_FEATURE (28)..(28): xaa=Nalpha-methyl threonine
  MOD_RES (31)..(31): AMIDATION
WVEHKLKGLLSXSGGVVRKNFVPTDVGXFAF

SEQ ID NO: 399 - protein, 31 aa, Artificial Sequence; identical to SEQ ID NO: 390
  CGRP peptide
  MISC_FEATURE: Lactam bridge between residues 3 and 7
  MOD_RES (1)..(1): ACETYLATION
  MISC_FEATURE (5)..(5): xaa=homocitrulline
  MISC_FEATURE (12)..(12): xaa=citrulline
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION

SEQ ID NO: 400 - protein, 31 aa, Artificial Sequence; identical to SEQ ID NO: 390
  CGRP peptide
  MISC_FEATURE: Lactam bridge between residues 3 and 7
  MOD_RES (1)..(1): ACETYLATION
  MISC_FEATURE (5)..(5): xaa=ornithine
  MISC_FEATURE (12)..(12): xaa=citrulline
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION

SEQ ID NO: 401 - protein, 31 aa, Artificial Sequence
  CGRP peptide
  MISC_FEATURE: Lactam bridge between residues 3 and 7
  MOD_RES (1)..(1): ACETYLATION
  MISC_FEATURE (12)..(12): xaa=citrulline
  MISC_FEATURE (24)..(24): xaa=Nalpha-methyl threonine
  MISC_FEATURE (28)..(28): xaa=Octahydroindole-2-Carboxylic Acid
  MISC_FEATURE (31)..(31): xaa=3-(2-naphthyl)alanine
  MOD_RES (31)..(31): AMIDATION
WVEHHLKGLLSXSGGVVRKNFVPXDVGXFAX

SEQ ID NO: 402 - protein, 31 aa, Artificial Sequence
  CGRP peptide
  MISC_FEATURE: Lactam bridge between residues 3 and 7
  MOD_RES (1)..(1): ACETYLATION
  MISC_FEATURE (5)..(5): xaa=citrulline
  MISC_FEATURE (12)..(12): xaa=citrulline
  MISC_FEATURE (28)..(28): xaa=Octahydroindole-2-Carboxylic Acid
  MOD_RES (31)..(31): AMIDATION
WVDHXLKGLLSXSGGVVRKNFVPTDVGXFAF

SEQ ID NO: 403 - protein, 31 aa, Artificial Sequence
  CGRP peptide
  MISC_FEATURE: Lactam bridge between residues 3 and 7
  MOD_RES (1)..(1): ACETYLATION
  MISC_FEATURE (12)..(12): xaa=citrulline
  MISC_FEATURE (28)..(28): xaa=Octahydroindole-2-Carboxylic Acid
  MOD_RES (31)..(31): AMIDATION
WVDHRLKGLLSXSGGVVRKNFVPTDVGXFAF

SEQ ID NO: 404 - protein, 31 aa, Artificial Sequence
  CGRP peptide
  MISC_FEATURE: lactam bridge between residues 3 and 7
  MOD_RES (1)..(1): ACETYLATION
  MISC_FEATURE (5)..(5): xaa=citrulline
  MISC_FEATURE (12)..(12): xaa=citrulline
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
WVDHXLKGLLSXSGGVVRKNFVPXDVGXFAF

SEQ ID NO: 405 - protein, 31 aa, Artificial Sequence
  CGRP peptide
  MISC_FEATURE: Lactam bridge between residues 3 and 7
  MOD_RES (1)..(1): ACETYLATION
  MISC_FEATURE (12)..(12): xaa=citrulline
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
WVDHRLKGLLSXSGGVVRKNFVPXDVGXFAF

SEQ ID NO: 406 - protein, 31 aa, Artificial Sequence
  CGRP peptide
  MISC_FEATURE: Lactam bridge between residues 3 and 7
  MOD_RES (1)..(1): ACETYLATION
  MISC_FEATURE (5)..(5): xaa=citrulline
  MISC_FEATURE (12)..(12): xaa=citrulline
  MISC_FEATURE (24)..(24): xaa=Nalpha-methyl threonine
  MISC_FEATURE (28)..(28): xaa=Octahydroindole-2-Carboxylic Acid
  MISC_FEATURE (31)..(31): xaa=3-(2-naphthyl)alanine
  MOD_RES (31)..(31): AMIDATION
WVDHXLKGLLSXSGGVVRKNFVPXDVGXFAX

SEQ ID NO: 407 - protein, 31 aa, Artificial Sequence
  CGRP peptide
  MOD_RES (1)..(1): ACETYLATION
  MISC_FEATURE (4)..(4): xaa=Nalpha-methyl-his
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION
WVTXXLAGLLSXSGGVVXKNFVPTDVGXFAF

SEQ ID NO: 408 - skipped

SEQ ID NO: 409 - protein, 31 aa, Artificial Sequence
  CGRP peptide
  MOD_RES (1)..(1): ACETYLATION
  MISC_FEATURE (4)..(4): xaa=Nalpha-methyl-his
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
WVTXXLAGLLSXSGGVVXKNFVPXDVGXFAF

SEQ ID NO: 410 - skipped

SEQ ID NO: 411 - protein, 31 aa, Artificial Sequence
  CGRP peptide
  MOD_RES (1)..(1): ACETYLATION
  MISC_FEATURE (4)..(4): xaa=Nalpha-methyl-his
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=3-(2-naphthyl)alanine
  MOD_RES (31)..(31): AMIDATION
WVTXXLAGLLSXSGGVVXKNFVPXDVGXFAX

SEQ ID NO: 412 - protein, 31 aa, Artificial Sequence; identical to SEQ ID NO: 411
  CGRP peptide
  MOD_RES (1)..(1): ACETYLATION
  MISC_FEATURE (4)..(4): xaa=Nmethyl histidine
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=Octahydroindole-2-Carboxylic Acid
  MISC_FEATURE (31)..(31): xaa=3-(1-naphthyl)alanine
  MOD_RES (31)..(31): AMIDATION

SEQ ID NO: 413 - protein, 31 aa, Artificial Sequence
  CGRP peptide
  MOD_RES (1)..(1): ACETYLATION
  MISC_FEATURE (4)..(4): xaa=Nalpha-methyl-his
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
WVTXXLAGLLSXSGGVVXKNFVPXDVGXFAW

SEQ ID NO: 414 - protein, 31 aa, Artificial Sequence
  CGRP peptide
  MOD_RES (1)..(1): ACETYLATION
  MISC_FEATURE (4)..(4): xaa=Nalpha-methyl-his
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
WVTXXLAGLLSXSGGVVXKNFVPXDVGXFAY

SEQ ID NO: 415 - protein, 31 aa, Artificial Sequence
  CGRP peptide
  MOD_RES (1)..(1): ACETYLATION
  MISC_FEATURE (4)..(4): xaa=Nalpha-methyl-his
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
WVTXXLAGLLSXSGGVVXKNFVPXDVGXFAH

SEQ ID NO: 416 - protein, 31 aa, Artificial Sequence
  CGRP peptide
  MISC_FEATURE: Lactam bridge between residues 3 and 7
  MOD_RES (1)..(1): ACETYLATION
  MISC_FEATURE (1)..(1): xaa=3-(1-naphthyl)alanine
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION
XVEHXLKGLLSXSGGVVXKNFVPTDVGXFAF

SEQ ID NO: 417 - protein, 31 aa, Artificial Sequence
  CGRP peptide
  MISC_FEATURE: Lactam bridge between residues 3 and 7
  MOD_RES (1)..(1): ACETYLATION
  MISC_FEATURE (1)..(1): xaa=3-(1-naphthyl)alanin
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION
XVEHRLKGLLSXSGGVVXKNFVPTDVGXFAF

SEQ ID NO: 418 - protein, 31 aa, Artificial Sequence
  CGRP peptide
  MISC_FEATURE: Lactam bridge between residues 3 and 7
  MOD_RES (1)..(1): ACETYLATION
  MISC_FEATURE (1)..(1): xaa=3-(1-naphthyl)alanine
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
XVEHXLKGLLSXSGGVVXKNFVPXDVGXFAF

SEQ ID NO: 419 - protein, 31 aa, Artificial Sequence
  CGRP peptide
  MISC_FEATURE: Lactam bridge between residues 3 and 7
  MOD_RES (1)..(1): ACETYLATION
  MISC_FEATURE (1)..(1): xaa=3-(1-naphthyl)alanine
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
XVEHRLKGLLSXSGGVVXKNFVPXDVGXFAF

SEQ ID NO: 420 - protein, 31 aa, Artificial Sequence
  CGRP peptide
  MISC_FEATURE: Lactam bridge between residues 3 and 7
  MOD_RES (1)..(1): ACETYLATION
  MISC_FEATURE (1)..(1): xaa=3-(1-naphthyl)alanine
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=Octahydroindole-2-Carboxylic Acid
  MISC_FEATURE (31)..(31): xaa=3-(2-naphthyl)alanine
  MOD_RES (31)..(31): AMIDATION
XVEHXLKGLLSXSGGVVXKNFVPXDVGXFAX

SEQ ID NO: 421 - protein, 31 aa, Artificial Sequence; identical to SEQ ID NO: 180
  CGRP peptide
  MISC_FEATURE: N-terminal=alpha amino replaced with benzyloxy carbonyl
  MISC_FEATURE: Lactam bridge between residues 3 and 7.
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION

SEQ ID NO: 422 - protein, 31 aa, Artificial Sequence; identical to SEQ ID NO: 181
  CGRP peptide
  MISC_FEATURE: Lactam bridge between residues 3 and 7.
  MISC_FEATURE: N-terminal=alpha amino replaced with benzyloxy carbonyl
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MOD_RES (28)..(28): ACETYLATION

SEQ ID NO: 423 - protein, 31 aa, Artificial Sequence; identical to SEQ ID NO: 182
  CGRP peptide
  MISC_FEATURE: Lactam bridge between residues 3 and 7.
  MISC_FEATURE: N-terminal=alpha amino replaced with benzyloxy carbonyl
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION

SEQ ID NO: 424 - protein, 31 aa, Artificial Sequence; identical to SEQ ID NO: 183
  CGRP peptide
  MISC_FEATURE: N-terminal=alpha amino replaced with benzyloxy carbonyl
  MISC_FEATURE: Lactam bridge between residues 3 and 7.
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION

SEQ ID NO: 425 - protein, 31 aa, Artificial Sequence; identical to SEQ ID NO: 188
  CGRP peptide
  MISC_FEATURE: N-terminal=alpha amino replaced with benzyloxy carbonyl
  MISC_FEATURE: Lactam bridge between residues 3 and 7.
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=Octahydroindole-2-Carboxylic Acid
  MISC_FEATURE (31)..(31): xaa=3-(2-naphthyl)alanine
  MOD_RES (31)..(31): AMIDATION

SEQ ID NO: 426 - protein, 31 aa, Artificial Sequence; identical to SEQ ID NO: 180
  CGRP peptide
  MISC_FEATURE: N-terminal=alpha amino replaced with benzyl
  MISC_FEATURE: Lactam bridge between residues 3 and 7.
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION

SEQ ID NO: 427 - protein, 31 aa, Artificial Sequence; identical to SEQ ID NO: 181
  CGRP peptide
  MISC_FEATURE: N-terminal=alpha amino replaced with benzyl
  MISC_FEATURE: Lactam bridge between residues 3 and 7.
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION

SEQ ID NO: 428 - protein, 31 aa, Artificial Sequence; identical to SEQ ID NO: 182
  CGRP peptide
  MISC_FEATURE: N-terminal=alpha amino replaced with benzyl
  MISC_FEATURE: Lactam bridge between residues 3 and 7.
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION

SEQ ID NO: 429 - protein, 31 aa, Artificial Sequence; identical to SEQ ID NO: 183
  CGRP peptide
  MISC_FEATURE: N-terminal=alpha amino replaced with benzyl
  MISC_FEATURE: Lactam bridge between residues 3 and 7.
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION

SEQ ID NO: 430 - protein, 31 aa, Artificial Sequence; identical to SEQ ID NO: 188
  CGRP peptide
  MISC_FEATURE: N-terminal=alpha amino replaced with benzyl
  MISC_FEATURE: Lactam bridge between residues 3 and 7.
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=Octahydroindole-2-Carboxylic Acid
  MISC_FEATURE (31)..(31): xaa=3-(2-naphthyl)alanine
  MOD_RES (31)..(31): AMIDATION

SEQ ID NO: 431 - protein, 31 aa, Artificial Sequence; identical to SEQ ID NO: 411
  CGRP peptide
  MISC_FEATURE: N-terminal=alpha amino replaced with benzyloxy carbonyl
  MISC_FEATURE (4)..(4): xaa=N-methylhistidine
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=Octahydroindole-2-Carboxylic Acid
  MISC_FEATURE (31)..(31): xaa=3-(1-naphthyl)alanine
  MOD_RES (31)..(31): AMIDATION

SEQ ID NO: 432 - protein, 31 aa, Artificial Sequence; identical to SEQ ID NO: 413
  CGRP peptide
  MISC_FEATURE: N-terminal=alpha amino replaced with benzyloxy carbonyl
  MISC_FEATURE (4)..(4): xaa=N-methylhistidine
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION

SEQ ID NO: 433 - protein, 31 aa, Artificial Sequence; identical to SEQ ID NO: 414
  CGRP peptide
  MISC_FEATURE: N-terminal=alpha amino replaced with benzyloxy carbonyl
  MISC_FEATURE (4)..(4): xaa=N-methylhistidine
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION

SEQ ID NO: 434 - protein, 31 aa, Artificial Sequence; identical to SEQ ID NO: 415
  CGRP peptide
  MISC_FEATURE: N-terminal=alpha amino replaced with benzyloxy carbonyl
  MISC_FEATURE (4)..(4): xaa=N-methylhistidine
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION

SEQ ID NO: 435 - protein, 31 aa, Artificial Sequence; identical to SEQ ID NO: 411
  CGRP peptide
  MISC_FEATURE: N-terminal=alpha amino replaced with benzyl
  MISC_FEATURE (4)..(4): xaa=N-methylhistidine
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=Octahydroindole-2-Carboxylic Acid
  MISC_FEATURE (31)..(31): xaa=3-(1-naphthyl)alanine
  MOD_RES (31)..(31): AMIDATION

SEQ ID NO: 436 - protein, 31 aa, Artificial Sequence; identical to SEQ ID NO: 413
  CGRP peptide
  MISC_FEATURE: N-terminal=alpha amino replaced with benzyl
  MISC_FEATURE (4)..(4): xaa=N-methylhistidine
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION

SEQ ID NO: 437 - protein, 31 aa, Artificial Sequence; identical to SEQ ID NO: 414
  CGRP peptide
  MISC_FEATURE: N-terminal=alpha amino replaced with benzyl
  MISC_FEATURE (4)..(4): xaa=N-methylhistidine
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION

SEQ ID NO: 438 - protein, 31 aa, Artificial Sequence; identical to SEQ ID NO: 415
  CGRP peptide
  MISC_FEATURE: N-terminal=alpha amino replaced with benzyl
  MISC_FEATURE (4)..(4): xaa=N-methylhistidine
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION

SEQ ID NO: 439 - protein, 31 aa, Artificial Sequence; identical to SEQ ID NO: 363
  CGRP peptide
  MISC_FEATURE: N-terminal=alpha amino replaced with benzyl
  MISC_FEATURE: Lactam bridge between residues 3 and 7.
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=Octahydroindole-2-Carboxylic Acid
  MISC_FEATURE (31)..(31): xaa=3-(1-naphthyl)alanine
  MOD_RES (31)..(31): AMIDATION

SEQ ID NO: 440 - protein, 31 aa, Artificial Sequence; identical to SEQ ID NO: 364
  CGRP peptide
  MISC_FEATURE: N-terminal=alpha amino replaced with benzyl
  MISC_FEATURE: Lactam bridge between residues 3 and 7.
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=pipecolic acid
  MOD_RES (31)..(31): AMIDATION

SEQ ID NO: 441 - protein, 31 aa, Artificial Sequence; identical to SEQ ID NO: 365
  CGRP peptide
  MISC_FEATURE: N-terminal=alpha amino replaced with benzyl
  MISC_FEATURE: Lactam bridge between residues 3 and 7.
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=hydroxy proline
  MOD_RES (31)..(31): AMIDATION

SEQ ID NO: 442 - protein, 31 aa, Artificial Sequence; identical to SEQ ID NO: 363
  CGRP peptide
  MISC_FEATURE: N-terminal=alpha amino replaced with benzyl
  MISC_FEATURE: Lactam bridge between residues 3 and 7.
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=hydroxy proline
  MISC_FEATURE (31)..(31): xaa=4,4'-biphenyl alanine
  MOD_RES (31)..(31): AMIDATION

SEQ ID NO: 443 - protein, 31 aa, Artificial Sequence; identical to SEQ ID NO: 363
  CGRP peptide
  MISC_FEATURE: N-terminal=alpha amino replaced with benzyl
  MISC_FEATURE: Lactam bridge between residues 3 and 7.
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=2-aminoindane-2-carboxylic acid
  MISC_FEATURE (31)..(31): xaa=3-(2-naphthyl)alanine
  MOD_RES (31)..(31): AMIDATION

SEQ ID NO: 444 - protein, 31 aa, Artificial Sequence; identical to SEQ ID NO: 368
  CGRP peptide
  MISC_FEATURE: N-terminal=alpha amino replaced with benzyl
  MISC_FEATURE: Lactam bridge between residues 3 and 7.
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=2-aminoindane-2-carboxylic acid
  MOD_RES (31)..(31): AMIDATION

SEQ ID NO: 445 - protein, 31 aa, Artificial Sequence
  CGRP peptide
  MISC_FEATURE: Lactam bridge between residues 1 and 5.
  MOD_RES (1)..(1): ACETYLATION
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
EVTHKLAGLLSXSGGVVXKNFVPXDVGXFAF

SEQ ID NO: 446 - protein, 31 aa, Artificial Sequence
  CGRP peptide
  MISC_FEATURE: Lactam bridge between residues 2 and 6.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
WETHXKAGLLSXSGGVVXKNFVPXDVGXFAF

SEQ ID NO: 447 - protein, 31 aa, Artificial Sequence; identical to SEQ ID NO: 182
  CGRP peptide
  MISC_FEATURE: Lactam bridge between residues 3 and 7.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION

SEQ ID NO: 448 - protein, 31 aa, Artificial Sequence
  CGRP peptide
  MISC_FEATURE: Lactam bridge between residues 4 and 8.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
WVTEXLAKLLSXSGGVVXKNFVPXDVGXFAF

SEQ ID NO: 449 - protein, 31 aa, Artificial Sequence
  CGRP peptide
  MISC_FEATURE: Lactam bridge between residues 5 and 9.
  MOD_RES (1)..(1): ACETYLATION
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
WVTHELAGKLSXSGGVVXKNFVPXDVGXFAF

SEQ ID NO: 450 - protein, 31 aa, Artificial Sequence
  CGRP peptide
  MISC_FEATURE: Lactam bridge between residues 6 and 10.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
WVTHXEAGLKSXSGGVVXKNFVPXDVGXFAF

SEQ ID NO: 451 - protein, 31 aa, Artificial Sequence
  CGRP peptide
  MISC_FEATURE: Lactam bridge between residues 7 and 11.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
WVTHXLEGLLKXSGGVVXKNFVPXDVGXFAF

SEQ ID NO: 452 - protein, 31 aa, Artificial Sequence
  CGRP peptide
  MISC_FEATURE: Lactam bridge between residues 8 and 12.
  MOD_RES (1)..(1): ACETYLATION
  MISC_FEATURE (5)..(5): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
WVTHXLAELLSKSGGVVXKNFVPXDVGXFAF

SEQ ID NO: 453 - protein, 31 aa, Artificial Sequence
  CGRP peptide
  MISC_FEATURE: Lactam bridge between residues 9 and 13.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
WVTHXLAGELSXKGGVVXKNFVPXDVGXFAF

SEQ ID NO: 454 - protein, 31 aa, Artificial Sequence
  CGRP peptide
  MISC_FEATURE: Lactam bridge between residues 10 and 14.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
WVTHXLAGLESXSKGVVXKNFVPXDVGXFAF

SEQ ID NO: 455 - protein, 31 aa, Artificial Sequence
  CGRP peptide
  MISC_FEATURE: Lactam bridge between residues 11 and 15.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
WVTHXLAGLLEXSGKVVXKNFVPXDVGXFAF

SEQ ID NO: 456 - protein, 31 aa, Artificial Sequence
  CGRP peptide
  MISC_FEATURE: Lactam bridge between residues 12 and 16.
  MOD_RES (1)..(1): ACETYLATION
  MISC_FEATURE (5)..(5): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
WVTHXLAGLLSESGGKVXKNFVPXDVGXFAF

SEQ ID NO: 457 - protein, 31 aa, Artificial Sequence
  CGRP peptide
  MISC_FEATURE: Lactam bridge between residues 13 and 17.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
WVTHXLAGLLSXEGGVKXKNFVPXDVGXFAF

SEQ ID NO: 458 - protein, 31 aa, Artificial Sequence
  CGRP peptide
  MISC_FEATURE: Lactam bridge between residues 20 and 25.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
WVTHXLAGLLSXSGGVVXKKFVPXDVGXFAF

SEQ ID NO: 459 - protein, 31 aa, Artificial Sequence
  CGRP peptide
  MISC_FEATURE: Lactam bridge between residues 21 and 26.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
WVTHXLAGLLSXSGGVVXKNKVPXDDGXFAF

SEQ ID NO: 460 - protein, 31 aa, Artificial Sequence
  CGRP peptide
  MISC_FEATURE: Lactam bridge between residues 22 and 27.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
WVTHXLAGLLSXSGGVVXKNFKPXDVDXFAF

SEQ ID NO: 461 - protein, 31 aa, Artificial Sequence; identical to SEQ ID NO: 278
  CGRP peptide
  MISC_FEATURE: Lactam bridge between residues 24 and 29.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION

SEQ ID NO: 462 - protein, 31 aa, Artificial Sequence
  CGRP peptide
  MISC_FEATURE: Lactam bridge between residues 25 and 30.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
WVTHXLAGLLSXSGGVVXKNFVPXKVGXFDF

SEQ ID NO: 463 - protein, 31 aa, Artificial Sequence
  CGRP peptide
  MISC_FEATURE: Lactam bridge between residues 26 and 31.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
WVTHXLAGLLSXSGGVVXKNFVPXDKGXFAD

SEQ ID NO: 464 - protein, 31 aa, Artificial Sequence
  CGRP peptide
  MISC_FEATURE: Lactam bridge between residues 3 and 7.
  MOD_RES (1)..(1): ACETYLATION
  MISC_FEATURE (5)..(5): xaa=citrulline
  MISC_FEATURE (12)..(12): xaa=citrulline
  MISC_FEATURE (28)..(28): xaa=Octahydroindole-2-Carboxylic Acid
  MOD_RES (31)..(31): AMIDATION
WVEHXLKGLLSXSGGVVKNNFVPTDVGXFAF

SEQ ID NO: 465 - protein, 31 aa, Artificial Sequence
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (28)..(28): xaa=Octahydroindole-2-Carboxylic Acid
  MOD_RES (31)..(31): AMIDATION
WVEHRLKGLLSXSGGVVKNNFVPTDVGXFAF

SEQ ID NO: 466 - protein, 31 aa, Artificial Sequence
  CGRP peptide
  MISC_FEATURE: Lactam bridge between residues 3 and 7.
  MOD_RES (1)..(1): ACETYLATION
  MISC_FEATURE (5)..(5): xaa=citrulline
  MISC_FEATURE (12)..(12): xaa=citrulline
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
WVEHXLKGLLSXSGGVVKNNFVPXDVGXFAF

SEQ ID NO: 467 - protein, 31 aa, Artificial Sequence
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
WVEHRLKGLLSXSGGVVKNNFVPXDVGXFAF

SEQ ID NO: 468 - protein, 31 aa, Artificial Sequence
  CGRP peptide
  MISC_FEATURE: Lactam bridge between residues 3 and 7.
  MOD_RES (1)..(1): ACETYLATION
  MISC_FEATURE (5)..(5): xaa=citrulline
  MISC_FEATURE (12)..(12): xaa=citrulline
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
  MISC_FEATURE (31)..(31): xaa=3-(2-naphthyl)alanine
WVEHXLKGLLSXSGGVVKNNFVPXDVGXFAX

SEQ ID NO: 469 - protein, 31 aa, Artificial Sequence; identical to SEQ ID NO: 464
  CGRP peptide
  MISC_FEATURE: Lactam bridge between residues 3 and 7.
  MOD_RES (1)..(1): ACETYLATION
  MISC_FEATURE (5)..(5): xaa=homoarginine
  MISC_FEATURE (12)..(12): xaa=citrulline
  MISC_FEATURE (28)..(28): xaa=Octahydroindole-2-Carboxylic Acid
  MOD_RES (31)..(31): AMIDATION

SEQ ID NO: 470 - protein, 31 aa, Artificial Sequence
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (28)..(28): xaa=Octahydroindole-2-Carboxylic Acid
  MOD_RES (31)..(31): AMIDATION
WVEHKLKGLLSXSGGVVKNNFVPTDVGXFAF

SEQ ID NO: 471 - protein, 31 aa, Artificial Sequence; identical to SEQ ID NO: 466
  CGRP peptide
  MISC_FEATURE: Lactam bridge between residues 3 and 7.
  MOD_RES (1)..(1): ACETYLATION
  MISC_FEATURE (5)..(5): xaa=homocitrulline
  MISC_FEATURE (12)..(12): xaa=citrulline
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION

SEQ ID NO: 472 - protein, 31 aa, Artificial Sequence; identical to SEQ ID NO: 466
  CGRP peptide
  MISC_FEATURE: Lactam bridge between residues 3 and 7.
  MOD_RES (1)..(1): ACETYLATION
  MISC_FEATURE (5)..(5): xaa=ornithine
  MISC_FEATURE (12)..(12): xaa=citrulline
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION

SEQ ID NO: 473 - protein, 31 aa, Artificial Sequence
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
  MISC_FEATURE (31)..(31): xaa=3-(2-naphthyl)alanine
WVEHHLKGLLSXSGGVVKNNFVPXDVGXFAX

SEQ ID NO: 474 - protein, 31 aa, Artificial Sequence
  CGRP peptide
  MISC_FEATURE: Lactam bridge between residues 3 and 7.
  MOD_RES (1)..(1): ACETYLATION
  MISC_FEATURE (5)..(5): xaa=citrulline
  MISC_FEATURE (12)..(12): xaa=citrulline
  MISC_FEATURE (28)..(28): xaa=Octahydroindole-2-Carboxylic Acid
  MOD_RES (31)..(31): AMIDATION
WVDHXLKGLLSXSGGVVKNNFVPTDVGXFAF

SEQ ID NO: 475 - protein, 31 aa, Artificial Sequence
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (28)..(28): xaa=Octahydroindole-2-Carboxylic Acid
  MOD_RES (31)..(31): AMIDATION
WVDHRLKGLLSXSGGVVKNNFVPTDVGXFAF

SEQ ID NO: 476 - protein, 31 aa, Artificial Sequence
  CGRP peptide
  MISC_FEATURE: Lactam bridge between residues 3 and 7.
  MOD_RES (1)..(1): ACETYLATION
  MISC_FEATURE (5)..(5): xaa=citrulline
  MISC_FEATURE (12)..(12): xaa=citrulline
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
WVDHXLKGLLSXSGGVVKNNFVPXDVGXFAF

SEQ ID NO: 477 - protein, 31 aa, Artificial Sequence
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
WVDHRLKGLLSXSGGVVKNNFVPXDVGXFAF

SEQ ID NO: 478 - protein, 31 aa, Artificial Sequence
  CGRP peptide
  MISC_FEATURE: Lactam bridge between residues 3 and 7.
  MOD_RES (1)..(1): ACETYLATION
  MISC_FEATURE (5)..(5): xaa=citrulline
  MISC_FEATURE (12)..(12): xaa=citrulline
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
  MISC_FEATURE (31)..(31): xaa=3-(2-naphthyl)alanine
WVDHXLKGLLSXSGGVVKNNFVPXDVGXFAX

SEQ ID NO: 479 - protein, 31 aa, Artificial Sequence
  CGRP peptide
  MISC_FEATURE: Lactam bridge between residues 3 and 7.
  MOD_RES (1)..(1): ACETYLATION
  MISC_FEATURE (5)..(5): xaa=citrulline
  MISC_FEATURE (12)..(12): xaa=citrulline
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
WVEHXLKGLLSXSGGVVKNNFVPXDVGXFAW

SEQ ID NO: 480 - protein, 31 aa, Artificial Sequence
  CGRP peptide
  MISC_FEATURE: Lactam bridge between residues 3 and 7.
  MOD_RES (1)..(1): ACETYLATION
  MISC_FEATURE (5)..(5): xaa=citrulline
  MISC_FEATURE (12)..(12): xaa=citrulline
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
WVEHXLKGLLSXSGGVVKNNFVPXDVGXFAH

SEQ ID NO: 481 - protein, 31 aa, Artificial Sequence; identical to SEQ ID NO: 468
  CGRP peptide
  MISC_FEATURE: Lactam bridge between residues 3 and 7.
  MOD_RES (1)..(1): ACETYLATION
  MISC_FEATURE (5)..(5): xaa=citrulline
  MISC_FEATURE (12)..(12): xaa=citrulline
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
  MISC_FEATURE (31)..(31): xaa=3-(1-naphthyl)alanine

SEQ ID NO: 482 - protein, 31 aa, Artificial Sequence; identical to SEQ ID NO: 468
  CGRP peptide
  MISC_FEATURE: Lactam bridge between residues 3 and 7.
  MOD_RES (1)..(1): ACETYLATION
  MISC_FEATURE (5)..(5): xaa=citrulline
  MISC_FEATURE (12)..(12): xaa=citrulline
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
  MISC_FEATURE (31)..(31): xaa=4,4'-biphenyl alanine

SEQ ID NO: 483 - protein, 31 aa, Artificial Sequence; identical to SEQ ID NO: 468
  CGRP peptide
  MISC_FEATURE: Lactam bridge between residues 3 and 7.
  MOD_RES (1)..(1): ACETYLATION
  MISC_FEATURE (5)..(5): xaa=citrulline
  MISC_FEATURE (12)..(12): xaa=citrulline
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
  MISC_FEATURE (31)..(31): xaa=1,2,3,4-L-Tetrahydroisoquinoline-3-Carboxylic acid

SEQ ID NO: 484 - protein, 31 aa, Artificial Sequence
  CGRP peptide
  MISC_FEATURE: Lactam bridge between residues 3 and 7.
  MOD_RES (1)..(1): ACETYLATION
  MISC_FEATURE (5)..(5): xaa=citrulline
  MISC_FEATURE (12)..(12): xaa=citrulline
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
WVEHXLKGLLSXSGGVVKNNFVPXDVGXFAY

SEQ ID NO: 485 - skipped

SEQ ID NO: 486 - protein, 31 aa, Artificial Sequence; identical to SEQ ID NO: 465
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (28)..(28): xaa=pipecolic acid
  MOD_RES (31)..(31): AMIDATION

SEQ ID NO: 487 - protein, 31 aa, Artificial Sequence; identical to SEQ ID NO: 465
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (28)..(28): xaa=hydroxy proline
  MOD_RES (31)..(31): AMIDATION

SEQ ID NO: 488 - skipped

SEQ ID NO: 489 - protein, 31 aa, Artificial Sequence; identical to SEQ ID NO: 465
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (28)..(28): xaa=2-aminoindane-2-carboxylic acid
  MOD_RES (31)..(31): AMIDATION

SEQ ID NO: 490 - skipped

SEQ ID NO: 491 - protein, 31 aa, Artificial Sequence; identical to SEQ ID NO: 465
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (28)..(28): xaa=aminoisobutyric acid
  MOD_RES (31)..(31): AMIDATION

SEQ ID NO: 492 - protein, 31 aa, Artificial Sequence; identical to SEQ ID NO: 465
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (28)..(28): xaa=Thiazolidine-4-carboxylic acid
  MOD_RES (31)..(31): AMIDATION

SEQ ID NO: 493 - protein, 31 aa, Artificial Sequence; identical to SEQ ID NO: 465
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (28)..(28): xaa=sarcosine
  MOD_RES (31)..(31): AMIDATION

SEQ ID NO: 494 - skipped

SEQ ID NO: 495 - protein, 31 aa, Artificial Sequence; identical to SEQ ID NO: 465
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (28)..(28): xaa=Tpi=1,2,3,4-Tetrahydronorharman-3-Carboxylic acid
  MOD_RES (31)..(31): AMIDATION

SEQ ID NO: 496-498 - skipped (3 entries)

SEQ ID NO: 499 - protein, 31 aa, Artificial Sequence
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (28)..(28): xaa=Octahydroindole-2-Carboxylic Acid
  MOD_RES (31)..(31): AMIDATION
WVTHXLAGLLSXSGGVVKNNFVPTDVGXFAF

SEQ ID NO: 500 - protein, 31 aa, Artificial Sequence; identical to SEQ ID NO: 499
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (28)..(28): xaa=pipecolic acid
  MOD_RES (31)..(31): AMIDATION

SEQ ID NO: 501 - protein, 31 aa, Artificial Sequence; identical to SEQ ID NO: 499
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (28)..(28): xaa=hydroxy proline
  MOD_RES (31)..(31): AMIDATION

SEQ ID NO: 502 - skipped

SEQ ID NO: 503 - protein, 31 aa, Artificial Sequence; identical to SEQ ID NO: 499
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (28)..(28): xaa=2-aminoindane-2-carboxylic acid
  MOD_RES (31)..(31): AMIDATION

SEQ ID NO: 504 - skipped

SEQ ID NO: 505 - protein, 31 aa, Artificial Sequence; identical to SEQ ID NO: 499
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (28)..(28): xaa=aminoisobutyric acid
  MOD_RES (31)..(31): AMIDATION

SEQ ID NO: 506 - protein, 31 aa, Artificial Sequence; identical to SEQ ID NO: 499
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (28)..(28): xaa=Thiazolidine-4-carboxylic acid
  MOD_RES (31)..(31): AMIDATION

SEQ ID NO: 507 - protein, 31 aa, Artificial Sequence; identical to SEQ ID NO: 499
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (28)..(28): xaa=sarcosine
  MOD_RES (31)..(31): AMIDATION

SEQ ID NO: 508 - skipped

SEQ ID NO: 509 - protein, 31 aa, Artificial Sequence; identical to SEQ ID NO: 499
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (28)..(28): xaa=Tpi=1,2,3,4-Tetrahydronorharman-3-Carboxylic acid
  MOD_RES (31)..(31): AMIDATION

SEQ ID NO: 510-512 - skipped (3 entries)

SEQ ID NO: 513 - protein, 31 aa, Artificial Sequence; identical to SEQ ID NO: 467
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (24)..(24): xaa=Nalpha-methyl threonine
  MISC_FEATURE (28)..(28): xaa=pipecolic acid
  MOD_RES (31)..(31): AMIDATION

SEQ ID NO: 514 - protein, 31 aa, Artificial Sequence; identical to SEQ ID NO: 467
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (24)..(24): xaa=Nalpha-methyl threonine
  MISC_FEATURE (28)..(28): xaa=hydroxy proline
  MOD_RES (31)..(31): AMIDATION

SEQ ID NO: 515 - skipped

SEQ ID NO: 516 - protein, 31 aa, Artificial Sequence; identical to SEQ ID NO: 467
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (24)..(24): xaa=Nalpha-methyl threonine
  MISC_FEATURE (28)..(28): xaa=2-aminoindane-2-carboxylic acid
  MOD_RES (31)..(31): AMIDATION

SEQ ID NO: 517 - skipped

SEQ ID NO: 518 - protein, 31 aa, Artificial Sequence; identical to SEQ ID NO: 467
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (24)..(24): xaa=Nalpha-methyl threonine
  MISC_FEATURE (28)..(28): xaa=aminoisobutyric acid
  MOD_RES (31)..(31): AMIDATION

SEQ ID NO: 519 - protein, 31 aa, Artificial Sequence; identical to SEQ ID NO: 467
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (24)..(24): xaa=Nalpha-methyl threonine
  MISC_FEATURE (28)..(28): xaa=Thiazolidine-4-carboxylic acid
  MOD_RES (31)..(31): AMIDATION

SEQ ID NO: 520 - protein, 31 aa, Artificial Sequence; identical to SEQ ID NO: 467
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (24)..(24): xaa=Nalpha-methyl threonine
  MISC_FEATURE (28)..(28): xaa=sarcosine
  MOD_RES (31)..(31): AMIDATION

SEQ ID NO: 521 - skipped

SEQ ID NO: 522 - protein, 31 aa, Artificial Sequence; identical to SEQ ID NO: 467
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (24)..(24): xaa=Nalpha-methyl threonine
  MISC_FEATURE (28)..(28): xaa=Tpi=1,2,3,4-Tetrahydronorharman-3-Carboxylic acid
  MOD_RES (31)..(31): AMIDATION

SEQ ID NO: 523-525 - skipped (3 entries)

SEQ ID NO: 526 - protein, 31 aa, Artificial Sequence
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
  MISC_FEATURE (31)..(31): xaa=3-(1-naphthyl)alanine
WVEHRLKGLLSXSGGVVKNNFVPXDVGXFAX

SEQ ID NO: 527 - protein, 31 aa, Artificial Sequence
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (24)..(24): xaa=Nalpha-methyl threonine
  MISC_FEATURE (28)..(28): xaa=pipecolic acid
  MOD_RES (31)..(31): AMIDATION
WVEHRLKGLLSXSGGVVKNNFVPXDVGXFAY

SEQ ID NO: 528 - protein, 31 aa, Artificial Sequence
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (24)..(24): xaa=Nalpha-methyl threonine
  MISC_FEATURE (28)..(28): xaa=hydroxy proline
  MOD_RES (31)..(31): AMIDATION
WVEHRLKGLLSXSGGVVKNNFVPXDVGXFAH

SEQ ID NO: 529 - protein, 31 aa, Artificial Sequence; identical to SEQ ID NO: 526
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (24)..(24): xaa=Nalpha-methyl threonine
  MISC_FEATURE (28)..(28): xaa=hydroxy proline
  MOD_RES (31)..(31): AMIDATION
  MISC_FEATURE (31)..(31): xaa=4,4'-biphenyl alanine

SEQ ID NO: 530 - protein, 31 aa, Artificial Sequence; identical to SEQ ID NO: 526
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (24)..(24): xaa=Nalpha-methyl threonine
  MISC_FEATURE (28)..(28): xaa=2-aminoindane-2-carboxylic acid
  MOD_RES (31)..(31): AMIDATION
  MISC_FEATURE (31)..(31): xaa=3-(2-naphthyl)alanine

SEQ ID NO: 531 - protein, 31 aa, Artificial Sequence
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (24)..(24): xaa=Nalpha-methyl threonine
  MISC_FEATURE (28)..(28): xaa=2-aminoindane-2-carboxylic acid
  MOD_RES (31)..(31): AMIDATION
WVEHRLKGLLSXSGGVVKNNFVPXDVGXFAW

SEQ ID NO: 532 - protein, 31 aa, Artificial Sequence; identical to SEQ ID NO: 358
  CGRP peptide
  MISC_FEATURE: Lactam bridge between residues 3 and 7.
  MOD_RES (1)..(1): ACETYLATION
  MISC_FEATURE (5)..(5): xaa=citrulline
  MISC_FEATURE (12)..(12): xaa=citrulline
  MISC_FEATURE (19)..(19): xaa=sarcosine
  MISC_FEATURE (28)..(28): xaa=Octahydroindole-2-Carboxylic Acid
  MOD_RES (31)..(31): AMIDATION

SEQ ID NO: 533 - protein, 31 aa, Artificial Sequence
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (19)..(19): xaa=sarcosine
  MISC_FEATURE (28)..(28): xaa=Octahydroindole-2-Carboxylic Acid
  MOD_RES (31)..(31): AMIDATION
WVEHRLKGLLSXSGGVVKXNFVPTDVGXFAF

SEQ ID NO: 534 - protein, 31 aa, Artificial Sequence; identical to SEQ ID NO: 360
  CGRP peptide
  MISC_FEATURE: Lactam bridge between residues 3 and 7.
  MOD_RES (1)..(1): ACETYLATION
  MISC_FEATURE (5)..(5): xaa=citrulline
  MISC_FEATURE (12)..(12): xaa=citrulline
  MISC_FEATURE (19)..(19): xaa=sarcosine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION

SEQ ID NO: 535 - protein, 31 aa, Artificial Sequence
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (19)..(19): xaa=sarcosine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
WVEHRLKGLLSXSGGVVKXNFVPXDVGXFAF

SEQ ID NO: 536 - protein, 31 aa, Artificial Sequence
  CGRP peptide
  MISC_FEATURE: Lactam bridge between residues 3 and 7.
  MOD_RES (1)..(1): ACETYLATION
  MISC_FEATURE (5)..(5): xaa=citrulline
  MISC_FEATURE (12)..(12): xaa=citrulline
  MISC_FEATURE (19)..(19): xaa=sarcosine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
  MISC_FEATURE (31)..(31): xaa=3-(2-naphthyl)alanine
WVEHXLKGLLSXSGGVVKXNFVPXDVGXFAX

SEQ ID NO: 537 - protein, 31 aa, Artificial Sequence; identical to SEQ ID NO: 358
  CGRP peptide
  MISC_FEATURE: Lactam bridge between residues 3 and 7.
  MOD_RES (1)..(1): ACETYLATION
  MISC_FEATURE (5)..(5): xaa=homoarginine
  MISC_FEATURE (12)..(12): xaa=citrulline
  MISC_FEATURE (19)..(19): xaa=sarcosine
  MISC_FEATURE (28)..(28): xaa=Octahydroindole-2-Carboxylic Acid
  MOD_RES (31)..(31): AMIDATION

SEQ ID NO: 538 - protein, 31 aa, Artificial Sequence; identical to SEQ ID NO: 359
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (19)..(19): xaa=sarcosine
  MISC_FEATURE (28)..(28): xaa=Octahydroindole-2-Carboxylic Acid
  MOD_RES (31)..(31): AMIDATION

SEQ ID NO: 539 - protein, 31 aa, Artificial Sequence; identical to SEQ ID NO: 360
  CGRP peptide
  MISC_FEATURE: Lactam bridge between residues 3 and 7.
  MOD_RES (1)..(1): ACETYLATION
  MISC_FEATURE (5)..(5): xaa=homocitrulline
  MISC_FEATURE (12)..(12): xaa=citrulline
  MISC_FEATURE (19)..(19): xaa=sarcosine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION

SEQ ID NO: 540 - protein, 31 aa, Artificial Sequence; identical to SEQ ID NO: 360
  CGRP peptide
  MISC_FEATURE: Lactam bridge between residues 3 and 7.
  MOD_RES (1)..(1): ACETYLATION
  MISC_FEATURE (5)..(5): xaa=ornithine
  MISC_FEATURE (12)..(12): xaa=citrulline
  MISC_FEATURE (19)..(19): xaa=sarcosine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION

SEQ ID NO: 541 - protein, 31 aa, Artificial Sequence; identical to SEQ ID NO: 362
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (19)..(19): xaa=sarcosine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
  MISC_FEATURE (31)..(31): xaa=3-(2-naphthyl)alanine

SEQ ID NO: 542 - protein, 31 aa, Artificial Sequence
  CGRP peptide
  MISC_FEATURE: Lactam bridge between residues 3 and 7.
  MOD_RES (1)..(1): ACETYLATION
  MISC_FEATURE (5)..(5): xaa=citrulline
  MISC_FEATURE (12)..(12): xaa=citrulline
  MISC_FEATURE (19)..(19): xaa=sarcosine
  MISC_FEATURE (28)..(28): xaa=Octahydroindole-2-Carboxylic Acid
  MOD_RES (31)..(31): AMIDATION
WVDHXLKGLLSXSGGVVKXNFVPTDVGXFAF

SEQ ID NO: 543 - protein, 31 aa, Artificial Sequence
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (19)..(19): xaa=sarcosine
  MISC_FEATURE (28)..(28): xaa=Octahydroindole-2-Carboxylic Acid
  MOD_RES (31)..(31): AMIDATION
WVDHRLKGLLSXSGGVVKXNFVPTDVGXFAF

SEQ ID NO: 544 - protein, 31 aa, Artificial Sequence
  CGRP peptide
  MISC_FEATURE: Lactam bridge between residues 3 and 7.
  MOD_RES (1)..(1): ACETYLATION
  MISC_FEATURE (5)..(5): xaa=citrulline
  MISC_FEATURE (12)..(12): xaa=citrulline
  MISC_FEATURE (19)..(19): xaa=sarcosine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
WVDHXLKGLLSXSGGVVKXNFVPXDVGXFAF

SEQ ID NO: 545 - protein, 31 aa, Artificial Sequence
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (19)..(19): xaa=sarcosine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
WVDHRLKGLLSXSGGVVKXNFVPXDVGXFAF

SEQ ID NO: 546 - protein, 31 aa, Artificial Sequence
  CGRP peptide
  MISC_FEATURE: Lactam bridge between residues 3 and 7.
  MOD_RES (1)..(1): ACETYLATION
  MISC_FEATURE (5)..(5): xaa=citrulline
  MISC_FEATURE (12)..(12): xaa=citrulline
  MISC_FEATURE (19)..(19): xaa=sarcosine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
  MISC_FEATURE (31)..(31): xaa=3-(2-naphthyl)alanine
WVDHXLKGLLSXSGGVVKXNFVPXDVGXFAX

SEQ ID NO: 547 - protein, 31 aa, Artificial Sequence
  CGRP peptide
  MISC_FEATURE: Lactam bridge between residues 3 and 7.
  MOD_RES (1)..(1): ACETYLATION
  MISC_FEATURE (5)..(5): xaa=citrulline
  MISC_FEATURE (12)..(12): xaa=citrulline
  MISC_FEATURE (19)..(19): xaa=sarcosine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
WVEHXLKGLLSXSGGVVKXNFVPXDVGXFAW

SEQ ID NO: 548 - protein, 31 aa, Artificial Sequence
  CGRP peptide
  MISC_FEATURE: Lactam bridge between residues 3 and 7.
  MOD_RES (1)..(1): ACETYLATION
  MISC_FEATURE (5)..(5): xaa=citrulline
  MISC_FEATURE (12)..(12): xaa=citrulline
  MISC_FEATURE (19)..(19): xaa=sarcosine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
WVEHXLKGLLSXSGGVVKXNFVPXDVGXFAH

SEQ ID NO: 549 - protein, 31 aa, Artificial Sequence; identical to SEQ ID NO: 536
  CGRP peptide
  MISC_FEATURE: Lactam bridge between residues 3 and 7.
  MOD_RES (1)..(1): ACETYLATION
  MISC_FEATURE (5)..(5): xaa=citrulline
  MISC_FEATURE (12)..(12): xaa=citrulline
  MISC_FEATURE (19)..(19): xaa=sarcosine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
  MISC_FEATURE (31)..(31): xaa=3-(1-naphthyl)alanine

SEQ ID NO: 550 - protein, 31 aa, Artificial Sequence; identical to SEQ ID NO: 536
  CGRP peptide
  MISC_FEATURE: Lactam bridge between residues 3 and 7.
  MOD_RES (1)..(1): ACETYLATION
  MISC_FEATURE (5)..(5): xaa=citrulline
  MISC_FEATURE (12)..(12): xaa=citrulline
  MISC_FEATURE (19)..(19): xaa=sarcosine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
  MISC_FEATURE (31)..(31): xaa=4,4'-biphenyl alanine

SEQ ID NO: 551 - protein, 31 aa, Artificial Sequence; identical to SEQ ID NO: 536
  CGRP peptide
  MISC_FEATURE: Lactam bridge between residues 3 and 7.
  MOD_RES (1)..(1): ACETYLATION
  MISC_FEATURE (5)..(5): xaa=citrulline
  MISC_FEATURE (12)..(12): xaa=citrulline
  MISC_FEATURE (19)..(19): xaa=sarcosine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
  MISC_FEATURE (31)..(31): xaa=1,2,3,4-L-Tetrahydroisoquinoline-3-Carboxylic acid

SEQ ID NO: 552 - protein, 31 aa, Artificial Sequence
  CGRP peptide
  MISC_FEATURE: Lactam bridge between residues 3 and 7.
  MOD_RES (1)..(1): ACETYLATION
  MISC_FEATURE (5)..(5): xaa=citrulline
  MISC_FEATURE (12)..(12): xaa=citrulline
  MISC_FEATURE (19)..(19): xaa=sarcosine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
WVEHXLKGLLSXSGGVVKXNFVPXDVGXFAY

SEQ ID NO: 553 - skipped

SEQ ID NO: 554 - protein, 31 aa, Artificial Sequence; identical to SEQ ID NO: 533
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (19)..(19): xaa=sarcosine
  MISC_FEATURE (28)..(28): xaa=pipecolic acid
  MOD_RES (31)..(31): AMIDATION

SEQ ID NO: 555 - protein, 31 aa, Artificial Sequence; identical to SEQ ID NO: 533
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (19)..(19): xaa=sarcosine
  MISC_FEATURE (28)..(28): xaa=hydroxy proline
  MOD_RES (31)..(31): AMIDATION

SEQ ID NO: 556 - skipped

SEQ ID NO: 557 - protein, 31 aa, Artificial Sequence; identical to SEQ ID NO: 533
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (19)..(19): xaa=sarcosine
  MISC_FEATURE (28)..(28): xaa=2-aminoindane-2-carboxylic acid
  MOD_RES (31)..(31): AMIDATION

SEQ ID NO: 558 - skipped

SEQ ID NO: 559 - protein, 31 aa, Artificial Sequence; identical to SEQ ID NO: 533
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (19)..(19): xaa=sarcosine
  MISC_FEATURE (28)..(28): xaa=aminoisobutyric acid
  MOD_RES (31)..(31): AMIDATION

SEQ ID NO: 560 - protein, 31 aa, Artificial Sequence; identical to SEQ ID NO: 533
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (19)..(19): xaa=sarcosine
  MISC_FEATURE (28)..(28): xaa=Thiazolidine-4-carboxylic acid
  MOD_RES (31)..(31): AMIDATION

SEQ ID NO: 561 - protein, 31 aa, Artificial Sequence; identical to SEQ ID NO: 533
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (19)..(19): xaa=sarcosine
  MISC_FEATURE (28)..(28): xaa=sarcosine
  MOD_RES (31)..(31): AMIDATION

SEQ ID NO: 562 - skipped

SEQ ID NO: 563 - protein, 31 aa, Artificial Sequence; identical to SEQ ID NO: 533
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (19)..(19): xaa=sarcosine
  MISC_FEATURE (28)..(28): xaa=Tpi=1,2,3,4-Tetrahydronorharman-3-Carboxylic acid
  MOD_RES (31)..(31): AMIDATION

SEQ ID NO: 564-566 - skipped (3 entries)

SEQ ID NO: 567 - protein, 31 aa, Artificial Sequence
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (19)..(19): xaa=sarcosine
  MISC_FEATURE (28)..(28): xaa=Octahydroindole-2-Carboxylic Acid
  MOD_RES (31)..(31): AMIDATION
WVTHXLAGLLSXSGGVVKXNFVPTDVGXFAF

SEQ ID NO: 568 - protein, 31 aa, Artificial Sequence; identical to SEQ ID NO: 567
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (19)..(19): xaa=sarcosine
  MISC_FEATURE (28)..(28): xaa=pipecolic acid
  MOD_RES (31)..(31): AMIDATION

SEQ ID NO: 569 - protein, 31 aa, Artificial Sequence; identical to SEQ ID NO: 567
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (19)..(19): xaa=sarcosine
  MISC_FEATURE (28)..(28): xaa=hydroxy proline
  MOD_RES (31)..(31): AMIDATION

SEQ ID NO: 570 - skipped

SEQ ID NO: 571 - protein, 31 aa, Artificial Sequence; identical to SEQ ID NO: 567
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (19)..(19): xaa=sarcosine
  MISC_FEATURE (28)..(28): xaa=2-aminoindane-2-carboxylic acid
  MOD_RES (31)..(31): AMIDATION

SEQ ID NO: 572 - skipped

SEQ ID NO: 573 - protein, 31 aa, Artificial Sequence; identical to SEQ ID NO: 567
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (19)..(19): xaa=sarcosine
  MISC_FEATURE (28)..(28): xaa=aminoisobutyric acid
  MOD_RES (31)..(31): AMIDATION

SEQ ID NO: 574 - protein, 31 aa, Artificial Sequence; identical to SEQ ID NO: 567
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (19)..(19): xaa=sarcosine
  MISC_FEATURE (28)..(28): xaa=Thiazolidine-4-carboxylic acid
  MOD_RES (31)..(31): AMIDATION

SEQ ID NO: 575 - protein, 31 aa, Artificial Sequence; identical to SEQ ID NO: 567
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (19)..(19): xaa=sarcosine
  MISC_FEATURE (28)..(28): xaa=sarcosine
  MOD_RES (31)..(31): AMIDATION

SEQ ID NO: 576 - skipped

SEQ ID NO: 577 - protein, 31 aa, Artificial Sequence; identical to SEQ ID NO: 567
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (19)..(19): xaa=sarcosine
  MISC_FEATURE (28)..(28): xaa=Tpi=1,2,3,4-Tetrahydronorharman-3-Carboxylic acid
  MOD_RES (31)..(31): AMIDATION

SEQ ID NO: 578-580 - skipped (3 entries)

SEQ ID NO: 581 - protein, 31 aa, Artificial Sequence; identical to SEQ ID NO: 535
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (19)..(19): xaa=sarcosine
  MISC_FEATURE (24)..(24): xaa=Nalpha-methyl threonine
  MISC_FEATURE (28)..(28): xaa=pipecolic acid
  MOD_RES (31)..(31): AMIDATION

SEQ ID NO: 582 - protein, 31 aa, Artificial Sequence; identical to SEQ ID NO: 535
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (19)..(19): xaa=sarcosine
  MISC_FEATURE (24)..(24): xaa=Nalpha-methyl threonine
  MISC_FEATURE (28)..(28): xaa=hydroxy proline
  MOD_RES (31)..(31): AMIDATION

SEQ ID NO: 583 - skipped

SEQ ID NO: 584 - protein, 31 aa, Artificial Sequence; identical to SEQ ID NO: 535
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (19)..(19): xaa=sarcosine
  MISC_FEATURE (24)..(24): xaa=Nalpha-methyl threonine
  MISC_FEATURE (28)..(28): xaa=2-aminoindane-2-carboxylic acid
  MOD_RES (31)..(31): AMIDATION

SEQ ID NO: 585 - skipped

SEQ ID NO: 586 - protein, 31 aa, Artificial Sequence; identical to SEQ ID NO: 535
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (19)..(19): xaa=sarcosine
  MISC_FEATURE (24)..(24): xaa=Nalpha-methyl threonine
  MISC_FEATURE (28)..(28): xaa=aminoisobutyric acid
  MOD_RES (31)..(31): AMIDATION

SEQ ID NO: 587 - protein, 31 aa, Artificial Sequence; identical to SEQ ID NO: 535
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (19)..(19): xaa=sarcosine
  MISC_FEATURE (24)..(24): xaa=Nalpha-methyl threonine
  MISC_FEATURE (28)..(28): xaa=Thiazolidine-4-carboxylic acid
  MOD_RES (31)..(31): AMIDATION

SEQ ID NO: 588 - protein, 31 aa, Artificial Sequence; identical to SEQ ID NO: 535
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (19)..(19): xaa=sarcosine
  MISC_FEATURE (24)..(24): xaa=Nalpha-methyl threonine
  MISC_FEATURE (28)..(28): xaa=sarcosine
  MOD_RES (31)..(31): AMIDATION

SEQ ID NO: 589 - skipped

SEQ ID NO: 590 - protein, 31 aa, Artificial Sequence; identical to SEQ ID NO: 535
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (19)..(19): xaa=sarcosine
  MISC_FEATURE (24)..(24): xaa=Nalpha-methyl threonine
  MISC_FEATURE (28)..(28): xaa=1,2,3,4-Tetrahydronorharman-3-Carboxylic acid
  MOD_RES (31)..(31): AMIDATION

SEQ ID NO: 591-593 - skipped (3 entries)

SEQ ID NO: 594 - protein, 31 aa, Artificial Sequence
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (19)..(19): xaa=sarcosine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
  MISC_FEATURE (31)..(31): xaa=3-(1-naphthyl)alanine
WVEHRLKGLLSXSGGVVKXNFVPXDVGXFAX

SEQ ID NO: 595 - protein, 31 aa, Artificial Sequence
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (19)..(19): xaa=sarcosine
  MISC_FEATURE (24)..(24): xaa=Nalpha-methyl threonine
  MISC_FEATURE (28)..(28): xaa=pipecolic acid
  MOD_RES (31)..(31): AMIDATION
WVEHRLKGLLSXSGGVVKXNFVPXDVGXFAY

SEQ ID NO: 596 - protein, 31 aa, Artificial Sequence
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (19)..(19): xaa=sarcosine
  MISC_FEATURE (24)..(24): xaa=Nalpha-methyl threonine
  MISC_FEATURE (28)..(28): xaa=hydroxy proline
  MOD_RES (31)..(31): AMIDATION
WVEHRLKGLLSXSGGVVKXNFVPXDVGXFAH

SEQ ID NO: 597 - protein, 31 aa, Artificial Sequence; identical to SEQ ID NO: 594
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (19)..(19): xaa=sarcosine
  MISC_FEATURE (24)..(24): xaa=Nalpha-methyl threonine
  MISC_FEATURE (28)..(28): xaa=hydroxy proline
  MOD_RES (31)..(31): AMIDATION
  MISC_FEATURE (31)..(31): xaa=4,4'-biphenyl alanine

SEQ ID NO: 598 - protein, 31 aa, Artificial Sequence; identical to SEQ ID NO: 594
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (19)..(19): xaa=sarcosine
  MISC_FEATURE (24)..(24): xaa=Nalpha-methyl threonine
  MISC_FEATURE (28)..(28): xaa=2-aminoindane-2-carboxylic acid
  MOD_RES (31)..(31): AMIDATION
  MISC_FEATURE (31)..(31): xaa=3-(2-naphthyl)alanine

SEQ ID NO: 599 - protein, 31 aa, Artificial Sequence
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (19)..(19): xaa=sarcosine
  MISC_FEATURE (24)..(24): xaa=Nalpha-methyl threonine
  MISC_FEATURE (28)..(28): xaa=2-aminoindane-2-carboxylic acid
  MOD_RES (31)..(31): AMIDATION
WVEHRLKGLLSXSGGVVKXNFVPXDVGXFAW

SEQ ID NO: 600 - protein, 31 aa, Artificial Sequence; identical to SEQ ID NO: 180
  CGRP peptide
  MISC_FEATURE: Lactam bridge between residues 3 and 7.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (19)..(19): PEGylated
  MISC_FEATURE (28)..(28): xaa=Octahydroindole-2-Carboxylic Acid
  MOD_RES (31)..(31): AMIDATION

SEQ ID NO: 601 - protein, 31 aa, Artificial Sequence; identical to SEQ ID NO: 181
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (18)..(18): xaa=homoarginine
  MISC_FEATURE (19)..(19): PEGylated
  MISC_FEATURE (28)..(28): xaa=Octahydroindole-2-Carboxylic Acid
  MOD_RES (31)..(31): AMIDATION

SEQ ID NO: 602 - protein, 31 aa, Artificial Sequence; identical to SEQ ID NO: 182
  CGRP peptide
  MISC_FEATURE: Lactam bridge between residues 3 and 7.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (19)..(19): PEGylated
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION

SEQ ID NO: 603 - protein, 31 aa, Artificial Sequence; identical to SEQ ID NO: 183
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (18)..(18): xaa=homoarginine
  MISC_FEATURE (19)..(19): PEGylated
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION

SEQ ID NO: 604-607 - skipped (4 entries)

SEQ ID NO: 608 - protein, 31 aa, Artificial Sequence; identical to SEQ ID NO: 188
  CGRP peptide
  MISC_FEATURE: Lactam bridge between residues 3 and 7.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (19)..(19): PEGylated
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
  MISC_FEATURE (31)..(31): xaa=3-(2-naphthyl)alanine

SEQ ID NO: 609 - protein, 31 aa, Artificial Sequence; identical to SEQ ID NO: 180
  CGRP peptide
  MISC_FEATURE: Lactam bridge between residues 3 and 7.
  MOD_RES (1)..(1): ACETYLATION
  MISC_FEATURE (5)..(5): xaa=homoarginine
  MISC_FEATURE (12)..(12): xaa=citrulline
  misc_feature (18)..(18): Xaa can be any naturally occurring amino acid
  MISC_FEATURE (19)..(19): PEGylated
  MISC_FEATURE (28)..(28): xaa=Octahydroindole-2-Carboxylic Acid
  MOD_RES (31)..(31): AMIDATION

SEQ ID NO: 610 - protein, 31 aa, Artificial Sequence; identical to SEQ ID NO: 190
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (18)..(18): xaa=homoarginine
  MISC_FEATURE (19)..(19): PEGylated
  MISC_FEATURE (28)..(28): xaa=Octahydroindole-2-Carboxylic Acid
  MOD_RES (31)..(31): AMIDATION

SEQ ID NO: 611 - protein, 31 aa, Artificial Sequence; identical to SEQ ID NO: 182
  CGRP peptide
  MISC_FEATURE: Lactam bridge between residues 3 and 7.
  MOD_RES (1)..(1): ACETYLATION
  MISC_FEATURE (5)..(5): xaa=homocitrulline
  MISC_FEATURE (12)..(12): xaa=citrulline
  MISC_FEATURE (18)..(18): xaa=homoarginine
  MISC_FEATURE (19)..(19): PEGylated
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION

SEQ ID NO: 612 - protein, 31 aa, Artificial Sequence; identical to SEQ ID NO: 182
  CGRP peptide
  MISC_FEATURE: Lactam bridge between residues 3 and 7.
  MOD_RES (1)..(1): ACETYLATION
  MISC_FEATURE (5)..(5): xaa=ornithine
  MISC_FEATURE (12)..(12): xaa=citrulline
  MISC_FEATURE (18)..(18): xaa=homoarginine
  MISC_FEATURE (19)..(19): PEGylated
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION

SEQ ID NO: 613 - protein, 31 aa, Artificial Sequence; identical to SEQ ID NO: 193
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (18)..(18): xaa=homoarginine
  MISC_FEATURE (19)..(19): PEGylated
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
  MISC_FEATURE (31)..(31): xaa=3-(2-naphthyl)alanine

SEQ ID NO: 614 - protein, 31 aa, Artificial Sequence; identical to SEQ ID NO: 194
  CGRP peptide
  MISC_FEATURE: Lactam bridge between residues 3 and 7.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (19)..(19): PEGylated
  MISC_FEATURE (28)..(28): xaa=Octahydroindole-2-Carboxylic Acid
  MOD_RES (31)..(31): AMIDATION

SEQ ID NO: 615 - protein, 31 aa, Artificial Sequence; identical to SEQ ID NO: 195
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (18)..(18): xaa=homoarginine
  MISC_FEATURE (19)..(19): PEGylated
  MISC_FEATURE (28)..(28): xaa=Octahydroindole-2-Carboxylic Acid
  MOD_RES (31)..(31): AMIDATION

SEQ ID NO: 616 - protein, 31 aa, Artificial Sequence; identical to SEQ ID NO: 196
  CGRP peptide
  MISC_FEATURE: Lactam bridge between residues 3 and 7.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (19)..(19): PEGylated
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION

SEQ ID NO: 617 - protein, 31 aa, Artificial Sequence; identical to SEQ ID NO: 197
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (18)..(18): xaa=homoarginine
  MISC_FEATURE (19)..(19): PEGylated
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION

SEQ ID NO: 618 - protein, 31 aa, Artificial Sequence; identical to SEQ ID NO: 198
  CGRP peptide
  MISC_FEATURE: Lactam bridge between residues 3 and 7.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (19)..(19): PEGylated
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
  MISC_FEATURE (31)..(31): xaa=3-(2-naphthyl)alanine

SEQ ID NO: 619 - protein, 31 aa, Artificial Sequence; identical to SEQ ID NO: 180
  CGRP peptide
  MISC_FEATURE: Lactam bridge between residues 3 and 7.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=citrulline
  MISC_FEATURE (19)..(19): PEGylated
  MISC_FEATURE (28)..(28): xaa=Octahydroindole-2-Carboxylic Acid
  MOD_RES (31)..(31): AMIDATION

SEQ ID NO: 620 - protein, 31 aa, Artificial Sequence; identical to SEQ ID NO: 181
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (18)..(18): xaa=citrulline
  MISC_FEATURE (19)..(19): PEGylated
  MISC_FEATURE (28)..(28): xaa=Octahydroindole-2-Carboxylic Acid
  MOD_RES (31)..(31): AMIDATION

SEQ ID NO: 621 - protein, 31 aa, Artificial Sequence; identical to SEQ ID NO: 182
  CGRP peptide
  MISC_FEATURE: Lactam bridge between residues 3 and 7.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=citrulline
  MISC_FEATURE (19)..(19): PEGylated
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION

SEQ ID NO: 622 - protein, 31 aa, Artificial Sequence; identical to SEQ ID NO: 183
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (18)..(18): xaa=citrulline
  MISC_FEATURE (19)..(19): PEGylated
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION

SEQ ID NO: 623 - protein, 31 aa, Artificial Sequence; identical to SEQ ID NO: 188
  CGRP peptide
  MISC_FEATURE: Lactam bridge between residues 3 and 7.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=citrulline
  MISC_FEATURE (19)..(19): PEGylated
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
  MISC_FEATURE (31)..(31): xaa=3-(2-naphthyl)alanine

SEQ ID NO: 624 - protein, 31 aa, Artificial Sequence; identical to SEQ ID NO: 180
  CGRP peptide
  MISC_FEATURE: Lactam bridge between residues 3 and 7.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=4-guanidinyl phenylalanine
  MISC_FEATURE (19)..(19): PEGylated
  MISC_FEATURE (28)..(28): xaa=Octahydroindole-2-Carboxylic Acid
  MOD_RES (31)..(31): AMIDATION

SEQ ID NO: 625 - protein, 31 aa, Artificial Sequence; identical to SEQ ID NO: 181
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (18)..(18): xaa=4-guanidinyl phenylalanine
  MISC_FEATURE (19)..(19): PEGylated
  MISC_FEATURE (28)..(28): xaa=Octahydroindole-2-Carboxylic Acid
  MOD_RES (31)..(31): AMIDATION

SEQ ID NO: 626 - protein, 31 aa, Artificial Sequence; identical to SEQ ID NO: 182
  CGRP peptide
  MISC_FEATURE: Lactam bridge between residues 3 and 7.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=4-guanidinyl phenylalanine
  MISC_FEATURE (19)..(19): PEGylated
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION

SEQ ID NO: 627 - protein, 31 aa, Artificial Sequence; identical to SEQ ID NO: 183
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (18)..(18): xaa=4-guanidinyl phenylalanine
  MISC_FEATURE (19)..(19): PEGylated
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION

SEQ ID NO: 628 - protein, 31 aa, Artificial Sequence; identical to SEQ ID NO: 188
  CGRP peptide
  MISC_FEATURE: Lactam bridge between residues 3 and 7.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=4-guanidinyl phenylalanine
  MISC_FEATURE (19)..(19): PEGylated
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
  MISC_FEATURE (31)..(31): xaa=3-(2-naphthyl)alanine

SEQ ID NO: 629 - protein, 31 aa, Artificial Sequence; identical to SEQ ID NO: 209
  CGRP peptide
  MISC_FEATURE: Lactam bridge between residues 3 and 7.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (19)..(19): PEGylated
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION

SEQ ID NO: 630 - protein, 31 aa, Artificial Sequence; identical to SEQ ID NO: 210
  CGRP peptide
  MISC_FEATURE: Lactam bridge between residues 3 and 7.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (19)..(19): PEGylated
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION

SEQ ID NO: 631 - protein, 31 aa, Artificial Sequence; identical to SEQ ID NO: 188
  CGRP peptide
  MISC_FEATURE: Lactam bridge between residues 3 and 7.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (19)..(19): PEGylated
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
  MISC_FEATURE (31)..(31): xaa=3-(1-naphthyl)alanine

SEQ ID NO: 632 - protein, 31 aa, Artificial Sequence; identical to SEQ ID NO: 188
  CGRP peptide
  MISC_FEATURE: Lactam bridge between residues 3 and 7.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (19)..(19): PEGylated
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
  MISC_FEATURE (31)..(31): xaa=4,4'-biphenyl alanine

SEQ ID NO: 633 - protein, 31 aa, Artificial Sequence; identical to SEQ ID NO: 188
  CGRP peptide
  MISC_FEATURE: Lactam bridge between residues 3 and 7.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (19)..(19): PEGylated
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
  MISC_FEATURE (31)..(31): xaa=1,2,3,4-L-Tetrahydroisoquinoline-3-Carboxylic acid

SEQ ID NO: 634 - protein, 31 aa, Artificial Sequence; identical to SEQ ID NO: 214
  CGRP peptide
  MISC_FEATURE: Lactam bridge between residues 3 and 7.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (19)..(19): PEGylated
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION

SEQ ID NO: 635 - protein, 31 aa, Artificial Sequence
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (19)..(19): PEGylated
  MISC_FEATURE (28)..(28): xaa=Octahydroindole-2-Carboxylic Acid
  MOD_RES (31)..(31): AMIDATION
WVTWXLAGLLSXSGGVVXKNFVPTDVGXFAF

SEQ ID NO: 636 - protein, 31 aa, Artificial Sequence; identical to SEQ ID NO: 407
  CGRP peptide
  MOD_RES (1)..(1): ACETYLATION
  MISC_FEATURE (4)..(4): xaa=Nalpha-methyl phenylaline
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (19)..(19): PEGylated
  MISC_FEATURE (28)..(28): xaa=Octahydroindole-2-Carboxylic Acid
  MOD_RES (31)..(31): AMIDATION

SEQ ID NO: 637 - protein, 31 aa, Artificial Sequence; identical to SEQ ID NO: 407
  CGRP peptide
  MOD_RES (1)..(1): ACETYLATION
  MISC_FEATURE (4)..(4): xaa=Nalpha-methyl tyrosine
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (19)..(19): PEGylated
  MISC_FEATURE (28)..(28): xaa=Octahydroindole-2-Carboxylic Acid
  MOD_RES (31)..(31): AMIDATION

SEQ ID NO: 638 - protein, 31 aa, Artificial Sequence; identical to SEQ ID NO: 407
  CGRP peptide
  MOD_RES (1)..(1): ACETYLATION
  MISC_FEATURE (4)..(4): xaa=sarcosine
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (19)..(19): PEGylated
  MISC_FEATURE (28)..(28): xaa=Octahydroindole-2-Carboxylic Acid
  MOD_RES (31)..(31): AMIDATION

SEQ ID NO: 639 - protein, 31 aa, Artificial Sequence
  CGRP peptide
  MOD_RES (1)..(1): ACETYLATION
  MISC_FEATURE (5)..(5): xaa=citrulline
  misc_feature (12)..(12): Xaa can be any naturally occurring amino acid
  MISC_FEATURE (18)..(18): xaa=homoarginine
  MISC_FEATURE (19)..(19): PEGylated
  MISC_FEATURE (28)..(28): xaa=Octahydroindole-2-Carboxylic Acid
  MOD_RES (31)..(31): AMIDATION
WVTAXLAGLLSXSGGVVXKNFVPTDVGXFAF

SEQ ID NO: 640 - protein, 31 aa, Artificial Sequence
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (19)..(19): PEGylated
  MISC_FEATURE (28)..(28): xaa=Octahydroindole-2-Carboxylic Acid
  MOD_RES (31)..(31): AMIDATION
WVTGXLAGLLSXSGGVVXKNFVPTDVGXFAF

SEQ ID NO: 641 - protein, 31 aa, Artificial Sequence; identical to SEQ ID NO: 407
  CGRP peptide
  MOD_RES (1)..(1): ACETYLATION
  MISC_FEATURE (4)..(4): xaa=Nalpha-methyl lysine
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (19)..(19): PEGylated
  MISC_FEATURE (28)..(28): xaa=Octahydroindole-2-Carboxylic Acid
  MOD_RES (31)..(31): AMIDATION

SEQ ID NO: 642 - protein, 31 aa, Artificial Sequence
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (19)..(19): PEGylated
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
WVTWXLAGLLSXSGGVVXKNFVPXDVGXFAF

SEQ ID NO: 643 - protein, 31 aa, Artificial Sequence; identical to SEQ ID NO: 409
  CGRP peptide
  MOD_RES (1)..(1): ACETYLATION
  MISC_FEATURE (4)..(4): xaa=Nalpha-methyl phenylaline
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (19)..(19): PEGylated
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION

SEQ ID NO: 644 - protein, 31 aa, Artificial Sequence; identical to SEQ ID NO: 409
  CGRP peptide
  MOD_RES (1)..(1): ACETYLATION
  MISC_FEATURE (4)..(4): xaa=Nalpha-methyl tyrosine
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (19)..(19): PEGylated
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION

SEQ ID NO: 645 - protein, 31 aa, Artificial Sequence; identical to SEQ ID NO: 409
  CGRP peptide
  MOD_RES (1)..(1): ACETYLATION
  MISC_FEATURE (4)..(4): xaa=sarcosine
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (19)..(19): PEGylated
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION

SEQ ID NO: 646 - protein, 31 aa, Artificial Sequence
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (19)..(19): PEGylated
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
WVTAXLAGLLSXSGGVVXKNFVPXDVGXFAF

SEQ ID NO: 647 - protein, 31 aa, Artificial Sequence
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (19)..(19): PEGylated
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
WVTGXLAGLLSXSGGVVXKNFVPXDVGXFAF

SEQ ID NO: 648 - protein, 31 aa, Artificial Sequence; identical to SEQ ID NO: 409
  CGRP peptide
  MOD_RES (1)..(1): ACETYLATION
  MISC_FEATURE (4)..(4): xaa=Nalpha-methyl lysine
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (19)..(19): PEGylated
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION

SEQ ID NO: 649 - protein, 31 aa, Artificial Sequence
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (19)..(19): xaa=sarcosine
  MISC_FEATURE (28)..(28): xaa=Octahydroindole-2-Carboxylic Acid
  MOD_RES (31)..(31): AMIDATION
WVTWXLAGLLSXSGGVVKXNFVPTDVGXFAF

SEQ ID NO: 650 - protein, 31 aa, Artificial Sequence
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (19)..(19): xaa=sarcosine
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
WVTWXLAGLLSXSGGVVKXNFVPXDVGXFAF

SEQ ID NO: 651 - protein, 31 aa, Artificial Sequence
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (28)..(28): xaa=Octahydroindole-2-Carboxylic Acid
  MOD_RES (31)..(31): AMIDATION
WVTWXLAGLLSXSGGVVKNNFVPTDVGXFAF

SEQ ID NO: 652 - protein, 31 aa, Artificial Sequence
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (24)..(24): xaa=Nalpha-methyl threonine
  MISC_FEATURE (28)..(28): xaa=Octahydroindole-2-Carboxylic Acid
  MOD_RES (31)..(31): AMIDATION
WVTWXLAGLLSXSGGVVKNNFVPXDVGXFAF

SEQ ID NO: 653 - protein, 31 aa, Artificial Sequence; identical to SEQ ID NO: 71
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MOD_RES (31)..(31): AMIDATION

SEQ ID NO: 654 - protein, 30 aa, Artificial Sequence
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MOD_RES (30)..(30): AMIDATION
WVTHXLAGLLSXSGGVVXKNFVPTDVGPFA

SEQ ID NO: 655 - protein, 29 aa, Artificial Sequence
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MOD_RES (29)..(29): AMIDATION
WVTHXLAGLLSXSGGVVXKNFVPTDVGPF

SEQ ID NO: 656 - protein, 29 aa, Artificial Sequence
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MOD_RES (29)..(29): AMIDATION
WVTHXLAGLLSXSGGVVXKNFVPTDVGPF

SEQ ID NO: 657 - protein, 27 aa, Artificial Sequence
  CGRP peptide
  MISC_FEATURE (1)..(1): xaa=citrulline
  MOD_RES (1)..(1): ACETYLATION
  MISC_FEATURE (8)..(8): xaa=citrulline
  MISC_FEATURE (14)..(14): xaa=homoarginine
  MOD_RES (27)..(27): AMIDATION
XLAGLLSXSGGVVXKNFVPTDVGPFAF

SEQ ID NO: 658 - protein, 31 aa, Artificial Sequence; identical to SEQ ID NO: 130
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION

SEQ ID NO: 659 - protein, 30 aa, Artificial Sequence
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MOD_RES (30)..(30): AMIDATION
WVTHXLAGLLSXSGGVVXKNFVPTDVGXFA

SEQ ID NO: 660 - protein, 30 aa, Artificial Sequence; identical to SEQ ID NO: 121
  CGRP peptide
  MOD_RES (1)..(1): ACETYLATION
  MISC_FEATURE (4)..(4): xaa=citrulline
  MISC_FEATURE (11)..(11): xaa=citrulline
  MISC_FEATURE (17)..(17): xaa=homoarginine
  MISC_FEATURE (27)..(27): xaa=Octahydroindole-2-Carboxylic Acid
  MOD_RES (30)..(30): AMIDATION

SEQ ID NO: 661 - protein, 27 aa, Artificial Sequence
  CGRP peptide
  MISC_FEATURE (1)..(1): xaa=citrulline
  MOD_RES (1)..(1): ACETYLATION
  MISC_FEATURE (8)..(8): xaa=citrulline
  MISC_FEATURE (14)..(14): xaa=homoarginine
  MISC_FEATURE (24)..(24): xaa=Octahydroindole-2-Carboxylic Acid
  MOD_RES (27)..(27): AMIDATION
XLAGLLSXSGGVVXKNFVPTDVGXFAF

SEQ ID NO: 662 - protein, 26 aa, Artificial Sequence
  CGRP peptide
  MOD_RES (1)..(1): ACETYLATION
  MISC_FEATURE (7)..(7): xaa=citrulline
  MISC_FEATURE (13)..(13): xaa=homoarginine
  MISC_FEATURE (23)..(23): xaa=Octahydroindole-2-Carboxylic Acid
  MOD_RES (26)..(26): AMIDATION
LAGLLSXSGGVVXKNFVPTDVGXFAF

SEQ ID NO: 663 - protein, 31 aa, Artificial Sequence
  CGRP peptide
  MISC_FEATURE: Lactam bridge between residues 9 and 13.
  MOD_RES (1)..(1): ACETYLATION
  MISC_FEATURE (12)..(12): xaa=citrulline
  MISC_FEATURE (18)..(18): xaa=homoarginine
  MOD_RES (31)..(31): AMIDATION
WVEHRLKGLLSXSGGVVXKNFVPTDVGPFAF

SEQ ID NO: 664 - protein, 31 aa, Artificial Sequence; identical to SEQ ID NO: 130
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=4-guanidinyl phenylalanine
  MISC_FEATURE (28)..(28): xaa=Octahydroindole-2-Carboxylic Acid
  MOD_RES (31)..(31): AMIDATION

SEQ ID NO: 665 - protein, 31 aa, Artificial Sequence
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=citrulline
  MISC_FEATURE (28)..(28): xaa=Octahydroindole-2-Carboxylic Acid
  MOD_RES (31)..(31): AMIDATION
WVTHXLAGLLSXSGGVVXKNFVPTDVGXKAF

SEQ ID NO: 666 - protein, 31 aa, Artificial Sequence; identical to SEQ ID NO: 130
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=pipecolic acid
  MOD_RES (31)..(31): AMIDATION

SEQ ID NO: 667 - protein, 31 aa, Artificial Sequence; identical to SEQ ID NO: 130
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=hydroxy proline
  MOD_RES (31)..(31): AMIDATION

SEQ ID NO: 668 - protein, 31 aa, Artificial Sequence; identical to SEQ ID NO: 130
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=hydroxy proline
  MOD_RES (31)..(31): AMIDATION

SEQ ID NO: 669 - protein, 31 aa, Artificial Sequence; identical to SEQ ID NO: 130
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=2-aminoindane-2-carboxylic acid
  MOD_RES (31)..(31): AMIDATION

SEQ ID NO: 670 - protein, 31 aa, Artificial Sequence; identical to SEQ ID NO: 130
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=aminoisobutyric acid
  MOD_RES (31)..(31): AMIDATION

SEQ ID NO: 671 - protein, 31 aa, Artificial Sequence; identical to SEQ ID NO: 130
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Thiazolidine-4-carboxylic acid
  MOD_RES (31)..(31): AMIDATION

SEQ ID NO: 672 - protein, 31 aa, Artificial Sequence; identical to SEQ ID NO: 130
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Sarcosine
  MOD_RES (31)..(31): AMIDATION

SEQ ID NO: 673 - protein, 31 aa, Artificial Sequence; identical to SEQ ID NO: 130
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=1,2,3,4-Tetrahydronorharman-3-Carboxylic acid
  MOD_RES (31)..(31): AMIDATION

SEQ ID NO: 674 - protein, 31 aa, Artificial Sequence; identical to SEQ ID NO: 131
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (29)..(29): xaa=3-(1-naphthyl)alanine
  MOD_RES (31)..(31): AMIDATION

SEQ ID NO: 675 - protein, 31 aa, Artificial Sequence; identical to SEQ ID NO: 283
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=pipecolic acid
  MISC_FEATURE (29)..(29): xaa=3-(1-naphthyl)alanine
  MOD_RES (31)..(31): AMIDATION

SEQ ID NO: 676 - protein, 31 aa, Artificial Sequence; identical to SEQ ID NO: 131
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (29)..(29): xaa=1,2,3,4-Tetrahydronorharman-3-Carboxylic acid
  MOD_RES (31)..(31): AMIDATION

SEQ ID NO: 677 - protein, 31 aa, Artificial Sequence; identical to SEQ ID NO: 7
  CGRP peptide
  MOD_RES (1)..(1): ACETYLATION
  MISC_FEATURE (19)..(19): PEGylated
  MOD_RES (31)..(31): AMIDATION

SEQ ID NO: 678-679 - skipped (2 entries)

SEQ ID NO: 680 - protein, 31 aa, Artificial Sequence; identical to SEQ ID NO: 8
  CGRP peptide
  MOD_RES (1)..(1): ACETYLATION
  MOD_RES (31)..(31): AMIDATION

SEQ ID NO: 681 - protein, 31 aa, Artificial Sequence; identical to SEQ ID NO: 8
  CGRP peptide
  MOD_RES (1)..(1): ACETYLATION
  MISC_FEATURE (19)..(19): PEGylated
  MOD_RES (31)..(31): AMIDATION

SEQ ID NO: 682 - protein, 31 aa, Artificial Sequence; identical to SEQ ID NO: 9
  CGRP peptide
  MOD_RES (1)..(1): ACETYLATION
  MOD_RES (31)..(31): AMIDATION

SEQ ID NO: 683 - protein, 31 aa, Artificial Sequence; identical to SEQ ID NO: 9
  CGRP peptide
  MOD_RES (1)..(1): ACETYLATION
  MISC_FEATURE (18)..(18): PEGylated
  MOD_RES (31)..(31): AMIDATION

SEQ ID NO: 684 - protein, 31 aa, Artificial Sequence; identical to SEQ ID NO: 5
  CGRP peptide
  MOD_RES (1)..(1): ACETYLATION
  MOD_RES (31)..(31): AMIDATION

SEQ ID NO: 685 - protein, 31 aa, Artificial Sequence; identical to SEQ ID NO: 5
  CGRP peptide
  MOD_RES (1)..(1): ACETYLATION
  MISC_FEATURE (18)..(18): PEGylated
  MOD_RES (31)..(31): AMIDATION

SEQ ID NO: 686 - protein, 31 aa, Artificial Sequence; identical to SEQ ID NO: 5
  CGRP peptide
  MOD_RES (1)..(1): ACETYLATION
  MISC_FEATURE (18)..(18): PEGylated
  MOD_RES (31)..(31): AMIDATION

SEQ ID NO: 687 - protein, 31 aa, Artificial Sequence; identical to SEQ ID NO: 5
  CGRP peptide
  MOD_RES (1)..(1): ACETYLATION
  MISC_FEATURE (18)..(18): PEGylated
  MOD_RES (31)..(31): AMIDATION

SEQ ID NO: 688 - protein, 31 aa, Artificial Sequence
  CGRP peptide
  MOD_RES (31)..(31): AMIDATION
WVTHRLAGLLSRSGGVVKCNFVPTNVGSKAF

SEQ ID NO: 689 - protein, 31 aa, Artificial Sequence; identical to SEQ ID NO: 231
  CGRP peptide
  MOD_RES (31)..(31): AMIDATION

SEQ ID NO: 690 - protein, 38 aa, Artificial Sequence; identical to SEQ ID NO: 2
  CGRP peptide
  MISC_FEATURE (1)..(1): PEGylated
  MOD_RES (38)..(38): AMIDATION

SEQ ID NO: 691 - protein, 30 aa, Artificial Sequence
  CGRP peptide
  MISC_FEATURE (17)..(17): PEGylated
  MOD_RES (30)..(30): AMIDATION
VTHRLAGLLSRSGGVVCNNFVPTNVGSKAF

SEQ ID NO: 692 - protein, 38 aa, Artificial Sequence; identical to SEQ ID NO: 3
  CGRP peptide
  MISC_FEATURE (1)..(1): PEGylated
  MOD_RES (38)..(38): AMIDATION

SEQ ID NO: 693 - protein, 30 aa, Artificial Sequence
  CGRP peptide
  MISC_FEATURE (18)..(18): PEGylated
  MOD_RES (30)..(30): AMIDATION
VTHRLAGLLSRSGGVVKCNFVPTNVGSKAF

SEQ ID NO: 694 - protein, 30 aa, Artificial Sequence; identical to SEQ ID NO: 693
  CGRP peptide
  MISC_FEATURE (18)..(18): PEGylated
  MOD_RES (30)..(30): AMIDATION

SEQ ID NO: 695 - protein, 31 aa, Artificial Sequence; identical to SEQ ID NO: 688
  CGRP peptide
  MISC_FEATURE (19)..(19): PEGylated
  MOD_RES (31)..(31): AMIDATION

SEQ ID NO: 696 - protein, 31 aa, Artificial Sequence; identical to SEQ ID NO: 231
  CGRP peptide
  MISC_FEATURE (19)..(19): PEGylated
  MOD_RES (31)..(31): AMIDATION

SEQ ID NO: 697 - protein, 39 aa, Artificial Sequence
  CGRP peptide
  MISC_FEATURE (1)..(1): PEGylated
  MOD_RES (39)..(39): AMIDATION
CGGGGGGGWVTHRLAGLLSRSGGVVKNNFVPTDVGPFAF

SEQ ID NO: 698 - protein, 31 aa, Artificial Sequence
  CGRP peptide
  MISC_FEATURE (1)..(1): xaa=benzyl
  MOD_RES (31)..(31): AMIDATION
XVTHRLAGLLSRSGGVVKNNFVPTNVGSKAF

SEQ ID NO: 699 - protein, 31 aa, Artificial Sequence; identical to SEQ ID NO: 698
  CGRP peptide
  MISC_FEATURE (1)..(1): xaa=benzyl
  MOD_RES (31)..(31): AMIDATION

SEQ ID NO: 700 - protein, 31 aa, Artificial Sequence
  CGRP peptide
  MISC_FEATURE (1)..(1): xaa=benzyl
  MOD_RES (31)..(31): AMIDATION
XVTHRLAGLLSRSGGVVKNNFVPTDVGPFAF

SEQ ID NO: 701 - protein, 31 aa, Artificial Sequence; identical to SEQ ID NO: 700
  CGRP peptide
  MISC_FEATURE (1)..(1): xaa=3-(1-naphthyl)alanine
  MOD_RES (31)..(31): AMIDATION

SEQ ID NO: 702 - protein, 31 aa, Artificial Sequence; identical to SEQ ID NO: 700
  CGRP peptide
  MISC_FEATURE (1)..(1): xaa=dibenzyl
  MOD_RES (31)..(31): AMIDATION

SEQ ID NO: 703 - protein, 31 aa, Artificial Sequence; identical to SEQ ID NO: 700
  CGRP peptide
  MISC_FEATURE (1)..(1): xaa=Phenylglycine
  MOD_RES (31)..(31): AMIDATION

SEQ ID NO: 704 - protein, 31 aa, Artificial Sequence; identical to SEQ ID NO: 700
  CGRP peptide
  MISC_FEATURE (1)..(1): xaa=cyclohexylalanine
  MOD_RES (31)..(31): AMIDATION

SEQ ID NO: 705 - protein, 30 aa, Artificial Sequence; identical to SEQ ID NO: 47
  CGRP peptide
  MOD_RES (1)..(1): ACETYLATION
  MOD_RES (30)..(30): AMIDATION

SEQ ID NO: 706 - protein, 30 aa, Artificial Sequence; identical to SEQ ID NO: 47
  CGRP peptide
  MOD_RES (1)..(1): ACETYLATION
  MOD_RES (30)..(30): AMIDATION

SEQ ID NO: 707 - protein, 38 aa, Artificial Sequence
  CGRP peptide
  MISC_FEATURE (8)..(8): xaa=acetamidomethyl
  MOD_RES (38)..(38): AMIDATION
ASDTATCXVTHRLAGLLSRSGGVVKNNFVPTNVGSKAF

SEQ ID NO: 708 - protein, 38 aa, Artificial Sequence
  CGRP peptide
  MOD_RES (1)..(1): ACETYLATION
  MISC_FEATURE (3)..(3): xaa=acetamidomethyl
  MOD_RES (38)..(38): AMIDATION
ACXDTATSVTHRLAGLLSRSGGVVKNNFVPTNVGSKAF

SEQ ID NO: 709 - protein, 37 aa, Artificial Sequence
  CGRP peptide
  MOD_RES (37)..(37): AMIDATION
ASDTATSVTHRLAGLLSRSGGVVKNNFVPTNVGSKAF

SEQ ID NO: 710 - protein, 13 aa, Artificial Sequence
  CGRP peptide
  MISC_FEATURE (2)..(2): xaa=6-aminohexanoic acid
  MOD_RES (13)..(13): AMIDATION
CXFVPTDVGPFAF

SEQ ID NO: 711 - protein, 12 aa, Artificial Sequence
  CGRP peptide
  MISC_FEATURE (6)..(6): xaa=D-val
  MOD_RES (12)..(12): AMIDATION
FVPTDXGAPFAF

SEQ ID NO: 712 - protein, 11 aa, Artificial Sequence
  CGRP peptide
  MISC_FEATURE (9)..(9): xaa=D-phe
  MOD_RES (11)..(11): AMIDATION
FVPTDVGPXAF

SEQ ID NO: 713 - protein, 11 aa, Artificial Sequence
  CGRP peptide
  MISC_FEATURE (8)..(8): xaa=D-pro
  MOD_RES (11)..(11): AMIDATION
FVPTDVGXFAF

SEQ ID NO: 714 - protein, 11 aa, Artificial Sequence
  CGRP peptide
  MISC_FEATURE (1)..(1): xaa=D-phe
  MOD_RES (11)..(11): AMIDATION
XVPTDVGPFAF

SEQ ID NO: 715 - protein, 11 aa, Artificial Sequence
  CGRP peptide
  MISC_FEATURE (10)..(10): xaa=D-ala
  MOD_RES (11)..(11): AMIDATION
FVPTDVGPFXF

SEQ ID NO: 716 - protein, 11 aa, Artificial Sequence
  CGRP peptide
  MISC_FEATURE (2)..(2): xaa=D-val
  MOD_RES (11)..(11): AMIDATION
FXPTDVGPFAF

SEQ ID NO: 717 - protein, 11 aa, Artificial Sequence
  CGRP peptide
  MOD_RES (11)..(11): AMIDATION
FVPTDVAPFAF

SEQ ID NO: 718 - protein, 11 aa, Artificial Sequence
  CGRP peptide
  MISC_FEATURE (3)..(3): xa=D-pro
  MOD_RES (11)..(11): AMIDATION
FVXTDVGPFAF

SEQ ID NO: 719 - protein, 11 aa, Artificial Sequence
  CGRP peptide
  MISC_FEATURE (5)..(5): xaa=D-asp
  MOD_RES (11)..(11): AMIDATION
FVPTXVGPFAF

SEQ ID NO: 720 - protein, 11 aa, Artificial Sequence
  CGRP peptide
  MISC_FEATURE (11)..(11): xaa=D-phe
  MOD_RES (11)..(11): AMIDATION
FVPTDVGPFAX

SEQ ID NO: 721 - protein, 19 aa, Artificial Sequence
  CGRP peptide
  MOD_RES (19)..(19): AMIDATION
CGGGGGGGFVPTDVGPFAF

SEQ ID NO: 722 - protein, 37 aa, Artificial Sequence
  CGRP peptide
  MISC_FEATURE (1)..(1): xaa=D-ala
  MOD_RES (37)..(37): AMIDATION
XCDTATCVTHRLAGLLSRSGGVVKNNFVPTNVGSKAF

SEQ ID NO: 723 - protein, 37 aa, Artificial Sequence
  CGRP peptide
  MISC_FEATURE (2)..(2): xaa=D-cys
  MOD_RES (37)..(37): AMIDATION
AXDTATCVTHRLAGLLSRSGGVVKNNFVPTNVGSKAF

SEQ ID NO: 724 - protein, 37 aa, Artificial Sequence
  CGRP peptide
  MISC_FEATURE (3)..(3): xaa=D-asp
  MOD_RES (37)..(37): AMIDATION
ACXTATCVTHRLAGLLSRSGGVVKNNFVPTNVGSKAF

SEQ ID NO: 725 - protein, 37 aa, Artificial Sequence
  CGRP peptide
  MISC_FEATURE (4)..(4): xaa=D-thr
  MOD_RES (37)..(37): AMIDATION
ACDXATCVTHRLAGLLSRSGGVVKNNFVPTNVGSKAF

SEQ ID NO: 726 - protein, 37 aa, Artificial Sequence
  CGRP peptide
  MISC_FEATURE (5)..(5): xaa=D-ala
  MOD_RES (37)..(37): AMIDATION
ACDTXTCVTHRLAGLLSRSGGVVKNNFVPTNVGSKAF

SEQ ID NO: 727 - skipped

SEQ ID NO: 728 - protein, 37 aa, Artificial Sequence
  CGRP peptide
  MISC_FEATURE (6)..(6): xaa=D-thr
  MOD_RES (37)..(37): AMIDATION
ACDTAXCVTHRLAGLLSRSGGVVKNNFVPTNVGSKAF

SEQ ID NO: 729 - protein, 37 aa, Artificial Sequence
  CGRP peptide
  MISC_FEATURE (7)..(7): xaa=D-cys
  MOD_RES (37)..(37): AMIDATION
ACDTATXVTHRLAGLLSRSGGVVKNNFVPTNVGSKAF

SEQ ID NO: 730 - protein, 37 aa, Artificial Sequence
  CGRP peptide
  MISC_FEATURE (8)..(8): xaa=D-val
  MOD_RES (37)..(37): AMIDATION
ACDTATCXTHRLAGLLSRSGGVVKNNFVPTNVGSKAF

SEQ ID NO: 731 - protein, 37 aa, Artificial Sequence
  CGRP peptide
  MISC_FEATURE (10)..(10): xaa=D-his
  MOD_RES (37)..(37): AMIDATION
ACDTATCVTXRLAGLLSRSGGVVKNNFVPTNVGSKAF

SEQ ID NO: 732 - protein, 37 aa, Artificial Sequence
  CGRP peptide
  MISC_FEATURE (9)..(9): xaa=D-thr
  MOD_RES (37)..(37): AMIDATION
ACDTATCVXHRLAGLLSRSGGVVKNNFVPTNVGSKAF

SEQ ID NO: 733 - protein, 31 aa, Artificial Sequence; identical to SEQ ID NO: 147
  CGRP peptide
  MOD_RES (1)..(1): ACETYLATION
  MOD_RES (31)..(31): AMIDATION

SEQ ID NO: 734 - protein, 31 aa, Artificial Sequence; identical to SEQ ID NO: 148
  CGRP peptide
  MOD_RES (1)..(1): ACETYLATION
  MISC_FEATURE (5)..(5): xaa=citrulline
  MOD_RES (31)..(31): AMIDATION

SEQ ID NO: 735 - protein, 31 aa, Artificial Sequence; identical to SEQ ID NO: 149
  CGRP peptide
  MOD_RES (1)..(1): ACETYLATION
  MISC_FEATURE (5)..(5): xaa=citrulline
  MOD_RES (31)..(31): AMIDATION

SEQ ID NO: 736 - protein, 31 aa, Artificial Sequence; identical to SEQ ID NO: 150
  CGRP peptide
  MOD_RES (1)..(1): ACETYLATION
  MISC_FEATURE (5)..(5): xaa=citrulline
  MOD_RES (31)..(31): AMIDATION

SEQ ID NO: 737 - protein, 31 aa, Artificial Sequence; identical to SEQ ID NO: 151
  CGRP peptide
  MOD_RES (1)..(1): ACETYLATION
  MOD_RES (31)..(31): AMIDATION

SEQ ID NO: 738 - protein, 31 aa, Artificial Sequence; identical to SEQ ID NO: 152
  CGRP peptide
  MOD_RES (1)..(1): ACETYLATION
  MISC_FEATURE (18)..(18): xaa=homoarginine
  MOD_RES (31)..(31): AMIDATION

SEQ ID NO: 739 - protein, 31 aa, Artificial Sequence; identical to SEQ ID NO: 71
  dup of 653, 757, 763 and 871
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MOD_RES (31)..(31): AMIDATION

SEQ ID NO: 740 - protein, 31 aa, Artificial Sequence; identical to SEQ ID NO: 154
  CGRP peptide
  MOD_RES (1)..(1): ACETYLATION
  MISC_FEATURE (19)..(19): xaa=4-amino-phenylalanine
  MOD_RES (31)..(31): AMIDATION

SEQ ID NO: 741 - protein, 31 aa, Artificial Sequence; identical to SEQ ID NO: 155
  CGRP peptide
  MOD_RES (1)..(1): ACETYLATION
  MISC_FEATURE (5)..(5): xaa=homoarginine
  MISC_FEATURE (12)..(12): xaa=citrulline
  MOD_RES (31)..(31): AMIDATION

SEQ ID NO: 742 - protein, 31 aa, Artificial Sequence; identical to SEQ ID NO: 105
  CGRP peptide
  MISC_FEATURE (1)..(1): xaa=3-(1-naphthyl)alanine
  MOD_RES (1)..(1): ACETYLATION
  MISC_FEATURE (5)..(5): xaa=homoarginine
  MISC_FEATURE (12)..(12): xaa=citrulline
  MOD_RES (31)..(31): AMIDATION

SEQ ID NO: 743 - protein, 32 aa, Artificial Sequence; identical to SEQ ID NO: 106
  CGRP peptide
  MISC_FEATURE (1)..(1): xaa=aminoisobutyric acid
  MOD_RES (1)..(1): ACETYLATION
  MISC_FEATURE (6)..(6): xaa=homoarginine
  MISC_FEATURE (13)..(13): xaa=citrulline
  MOD_RES (32)..(32): AMIDATION

SEQ ID NO: 744 - protein, 31 aa, Artificial Sequence; identical to SEQ ID NO: 25
  CGRP peptide
  MOD_RES (1)..(1): ACETYLATION
  MISC_FEATURE (5)..(5): xaa=citrulline
  MISC_FEATURE (12)..(12): xaa=citrulline
  MOD_RES (31)..(31): AMIDATION

SEQ ID NO: 745 - protein, 31 aa, Artificial Sequence; identical to SEQ ID NO: 71
  CGRP peptide
  MOD_RES (1)..(1): ACETYLATION
  MISC_FEATURE (5)..(5): xaa=homocitruline
  MISC_FEATURE (12)..(12): xaa=homocitruline
  MISC_FEATURE (18)..(18): xaa=homoarginine
  MOD_RES (31)..(31): AMIDATION

SEQ ID NO: 746 - protein, 31 aa, Artificial Sequence; identical to SEQ ID NO: 71
  CGRP peptide
  MOD_RES (1)..(1): ACETYLATION
  MISC_FEATURE (5)..(5): xaa=homoarginine
  MISC_FEATURE (12)..(12): xaa=homocitruline
  MISC_FEATURE (18)..(18): xaa=homoarginine
  MOD_RES (31)..(31): AMIDATION

SEQ ID NO: 747 - protein, 31 aa, Artificial Sequence; identical to SEQ ID NO: 71
  CGRP peptide
  MOD_RES (1)..(1): ACETYLATION
  MISC_FEATURE (5)..(5): xaa=homoarginine
  MISC_FEATURE (12)..(12): xaa=citrulline
  MISC_FEATURE (18)..(18): xaa=homoarginine
  MOD_RES (31)..(31): AMIDATION

SEQ ID NO: 748 - protein, 31 aa, Artificial Sequence; identical to SEQ ID NO: 71
  CGRP peptide
  MOD_RES (1)..(1): ACETYLATION
  MISC_FEATURE (5)..(5): xaa=homoarginine
  MISC_FEATURE (12)..(12): xaa=homoarginine
  MISC_FEATURE (18)..(18): xaa=homoarginine
  MOD_RES (31)..(31): AMIDATION

SEQ ID NO: 749 - protein, 32 aa, Artificial Sequence; identical to SEQ ID NO: 163
  CGRP peptide
  MOD_RES (1)..(1): ACETYLATION
  MISC_FEATURE (12)..(12): xaa=citrulline
  MISC_FEATURE (19)..(19): xaa=homoarginine
  MOD_RES (32)..(32): AMIDATION

SEQ ID NO: 750 - protein, 32 aa, Artificial Sequence; identical to SEQ ID NO: 164
  CGRP peptide
  MOD_RES (1)..(1): ACETYLATION
  MISC_FEATURE (5)..(5): xaa=citrulline
  MISC_FEATURE (19)..(19): xaa=homoarginine
  MOD_RES (32)..(32): AMIDATION

SEQ ID NO: 751 - protein, 32 aa, Artificial Sequence; identical to SEQ ID NO: 165
  CGRP peptide
  MOD_RES (1)..(1): ACETYLATION
  MISC_FEATURE (5)..(5): xaa=citrulline
  MISC_FEATURE (12)..(12): xaa=homoarginine
  MISC_FEATURE (19)..(19): xaa=homoarginine
  MOD_RES (32)..(32): AMIDATION

SEQ ID NO: 752 - protein, 32 aa, Artificial Sequence; identical to SEQ ID NO: 165
  CGRP peptide
  MOD_RES (1)..(1): ACETYLATION
  MISC_FEATURE (5)..(5): xaa=homocitruline
  MISC_FEATURE (12)..(12): xaa=homoarginine
  MISC_FEATURE (19)..(19): xaa=homoarginine
  MOD_RES (32)..(32): AMIDATION

SEQ ID NO: 753 - protein, 32 aa, Artificial Sequence; identical to SEQ ID NO: 167
  CGRP peptide
  MOD_RES (1)..(1): ACETYLATION
  MISC_FEATURE (12)..(12): xaa=citrulline
  MISC_FEATURE (19)..(19): xaa=homoarginine
  MOD_RES (32)..(32): AMIDATION

SEQ ID NO: 754 - protein, 32 aa, Artificial Sequence; identical to SEQ ID NO: 168
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (19)..(19): xaa=homoarginine
  MOD_RES (32)..(32): AMIDATION

SEQ ID NO: 755 - protein, 30 aa, Artificial Sequence
  CGRP peptide
  MOD_RES (1)..(1): ACETYLATION
  MISC_FEATURE (12)..(12): xaa=homoarginine
  MISC_FEATURE (19)..(19): xaa=homoarginine
  MOD_RES (30)..(30): AMIDATION
WVEHRLKGLLSXSGGVVRXKNFVPTDVGPF

SEQ ID NO: 756 - protein, 32 aa, Artificial Sequence; identical to SEQ ID NO: 170
  CGRP peptide
  MOD_RES (1)..(1): ACETYLATION
  MISC_FEATURE (19)..(19): xaa=homoarginine
  MOD_RES (32)..(32): AMIDATION

SEQ ID NO: 757 - skipped

SEQ ID NO: 758 - protein, 31 aa, Artificial Sequence; identical to SEQ ID NO: 71
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=4-guanidinyl phenylalanine
  MOD_RES (31)..(31): AMIDATION

SEQ ID NO: 759 - protein, 31 aa, Artificial Sequence; identical to SEQ ID NO: 131
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (29)..(29): xaa=4,4'-biphenyl alanine
  MOD_RES (31)..(31): AMIDATION

SEQ ID NO: 760 - protein, 31 aa, Artificial Sequence; identical to SEQ ID NO: 131
  CGRP peptide
  MOD_RES (1)..(1): ACETYLATION
  MISC_FEATURE (5)..(5): xaa=homoarginine
  MISC_FEATURE (12)..(12): xaa=citrulline
  MISC_FEATURE (18)..(18): xaa=homoarginine
  MISC_FEATURE (29)..(29): xaa=3-(2-naphthyl)alanine
  MOD_RES (31)..(31): AMIDATION

SEQ ID NO: 761 - protein, 31 aa, Artificial Sequence; identical to SEQ ID NO: 131
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (29)..(29): xaa=Indanyl glycine
  MOD_RES (31)..(31): AMIDATION

SEQ ID NO: 762 - protein, 31 aa, Artificial Sequence; identical to SEQ ID NO: 178
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (21)..(21): xaa=4-iodophenylalanine
  MISC_FEATURE (29)..(29): xaa=4-iodophenylalanine
  MOD_RES (31)..(31): AMIDATION

SEQ ID NO: 763 - skipped

SEQ ID NO: 764 - protein, 31 aa, Artificial Sequence; identical to SEQ ID NO: 8
  CGRP peptide
  MOD_RES (1)..(1): ACETYLATION
  MOD_RES (31)..(31): AMIDATION

SEQ ID NO: 765 - protein, 31 aa, Artificial Sequence; identical to SEQ ID NO: 8
  CGRP peptide
  MOD_RES (1)..(1): ACETYLATION
  MISC_FEATURE (19)..(19): PEGylated
  MOD_RES (31)..(31): AMIDATION

SEQ ID NO: 766 - protein, 31 aa, Artificial Sequence; identical to SEQ ID NO: 8
  CGRP peptide
  MOD_RES (1)..(1): ACETYLATION
  MISC_FEATURE (19)..(19): PEGylated
  MOD_RES (31)..(31): AMIDATION

SEQ ID NO: 767 - protein, 31 aa, Artificial Sequence; identical to SEQ ID NO: 8
  CGRP peptide
  MOD_RES (1)..(1): ACETYLATION
  MISC_FEATURE (19)..(19): PEGylated
  MOD_RES (31)..(31): AMIDATION

SEQ ID NO: 768 - protein, 31 aa, Artificial Sequence; identical to SEQ ID NO: 8
  CGRP peptide
  MOD_RES (1)..(1): ACETYLATION
  MISC_FEATURE (19)..(19): PEGylated
  MOD_RES (31)..(31): AMIDATION

SEQ ID NO: 769 - protein, 31 aa, Artificial Sequence; identical to SEQ ID NO: 8
  CGRP peptide
  MOD_RES (1)..(1): ACETYLATION
  MISC_FEATURE (19)..(19): PEGylated
  MOD_RES (31)..(31): AMIDATION

SEQ ID NO: 770 - protein, 31 aa, Artificial Sequence; identical to SEQ ID NO: 8
  CGRP peptide
  MOD_RES (1)..(1): ACETYLATION
  MISC_FEATURE (19)..(19): PEGylated
  MOD_RES (31)..(31): AMIDATION

SEQ ID NO: 771 - protein, 31 aa, Artificial Sequence; identical to SEQ ID NO: 8
  CGRP peptide
  MOD_RES (1)..(1): ACETYLATION
  MISC_FEATURE (19)..(19): PEGylated
  MOD_RES (31)..(31): AMIDATION

SEQ ID NO: 772 - protein, 31 aa, Artificial Sequence; identical to SEQ ID NO: 33
  CGRP peptide
  MOD_RES (1)..(1): ACETYLATION
  MOD_RES (31)..(31): AMIDATION

SEQ ID NO: 773 - protein, 31 aa, Artificial Sequence; identical to SEQ ID NO: 33
  CGRP peptide
  MOD_RES (1)..(1): ACETYLATION
  MISC_FEATURE (19)..(19): PEGylated
  MOD_RES (31)..(31): AMIDATION

SEQ ID NO: 774 - protein, 31 aa, Artificial Sequence; identical to SEQ ID NO: 35
  CGRP peptide
  MOD_RES (1)..(1): AMIDATION
  MISC_FEATURE (19)..(19): PEGylated
  MOD_RES (31)..(31): AMIDATION

SEQ ID NO: 775 - protein, 31 aa, Artificial Sequence; identical to SEQ ID NO: 35
  CGRP peptide
  MOD_RES (1)..(1): ACETYLATION
  MISC_FEATURE (19)..(19): PEGylated
  MOD_RES (31)..(31): AMIDATION

SEQ ID NO: 776 - protein, 31 aa, Artificial Sequence; identical to SEQ ID NO: 41
  CGRP peptide
  MOD_RES (1)..(1): ACETYLATION
  MISC_FEATURE (12)..(12): xaa=D-Arginine
  MOD_RES (31)..(31): AMIDATION

SEQ ID NO: 777 - protein, 31 aa, Artificial Sequence; identical to SEQ ID NO: 41
  CGRP peptide
  MOD_RES (1)..(1): ACETYLATION
  MISC_FEATURE (12)..(12): D-Arginine
  MISC_FEATURE (19)..(19): PEGylated
  MOD_RES (31)..(31): AMIDATION

SEQ ID NO: 778 - protein, 30 aa, Artificial Sequence; identical to SEQ ID NO: 54
  CGRP peptide
  MOD_RES (1)..(1): ACETYLATION
  MISC_FEATURE (1)..(1): 3IPA
  MOD_RES (30)..(30): AMIDATION

SEQ ID NO: 779 - protein, 30 aa, Artificial Sequence; identical to SEQ ID NO: 54
  CGRP peptide
  MISC_FEATURE (1)..(1): 3IPA
  MOD_RES (1)..(1): ACETYLATION
  MISC_FEATURE (18)..(18): PEGylated
  MOD_RES (30)..(30): AMIDATION

SEQ ID NO: 780 - skipped

SEQ ID NO: 781 - protein, 31 aa, Artificial Sequence; identical to SEQ ID NO: 8
  CGRP peptide
  MOD_RES (1)..(1): ACETYLATION
  MISC_FEATURE (19)..(19): PEGylated, trivalent
  MOD_RES (31)..(31): AMIDATION

SEQ ID NO: 782 - protein, 31 aa, Artificial Sequence; identical to SEQ ID NO: 8
  CGRP peptide
  MOD_RES (1)..(1): ACETYLATION
  MISC_FEATURE (19)..(19): PEGylated, tetravalent
  MOD_RES (31)..(31): AMIDATION

SEQ ID NO: 783 - protein, 31 aa, Artificial Sequence; identical to SEQ ID NO: 8
  CGRP peptide
  MOD_RES (1)..(1): ACETYLATION
  MISC_FEATURE (19)..(19): PEGylated, octavalent
  MOD_RES (31)..(31): AMIDATION

SEQ ID NO: 784 - protein, 31 aa, Artificial Sequence; identical to SEQ ID NO: 25
  CGRP peptide
  MOD_RES (1)..(1): ACETYLATION
  MISC_FEATURE (5)..(5): xaa=homoarginine
  MISC_FEATURE (12)..(12): xaa=homoarginine
  MOD_RES (31)..(31): AMIDATION

SEQ ID NO: 785 - protein, 31 aa, Artificial Sequence; identical to SEQ ID NO: 25
  CGRP peptide
  MOD_RES (1)..(1): ACETYLATION
  MISC_FEATURE (5)..(5): xaa=homoarginine
  MISC_FEATURE (12)..(12): xaa=homoarginine
  MISC_FEATURE (19)..(19): PEGylated
  MOD_RES (31)..(31): AMIDATION

SEQ ID NO: 786 - protein, 31 aa, Artificial Sequence; identical to SEQ ID NO: 23
  CGRP peptide
  MOD_RES (1)..(1): ACETYLATION
  MISC_FEATURE (12)..(12): xaa=homoarginine
  MOD_RES (31)..(31): AMIDATION

SEQ ID NO: 787 - protein, 31 aa, Artificial Sequence; identical to SEQ ID NO: 23
  CGRP peptide
  MOD_RES (1)..(1): ACETYLATION
  MISC_FEATURE (12)..(12): xaa=homoarginine
  MISC_FEATURE (19)..(19): PEGylated
  MOD_RES (31)..(31): AMIDATION

SEQ ID NO: 788 - protein, 31 aa, Artificial Sequence; identical to SEQ ID NO: 21
  CGRP peptide
  MOD_RES (1)..(1): ACETYLATION
  MISC_FEATURE (5)..(5): xaa=homoarginine
  MOD_RES (31)..(31): AMIDATION

SEQ ID NO: 789 - protein, 31 aa, Artificial Sequence; identical to SEQ ID NO: 21
  CGRP peptide
  MOD_RES (1)..(1): ACETYLATION
  MISC_FEATURE (5)..(5): xaa=homoarginine
  MISC_FEATURE (19)..(19): PEGylated
  MOD_RES (31)..(31): AMIDATION

SEQ ID NO: 790 - protein, 31 aa, Artificial Sequence; identical to SEQ ID NO: 25
  CGRP peptide
  MOD_RES (1)..(1): ACETYLATION
  MISC_FEATURE (5)..(5): xaa=citrulline
  MISC_FEATURE (12)..(12): xaa=citrulline
  MOD_RES (31)..(31): AMIDATION

SEQ ID NO: 791 - protein, 31 aa, Artificial Sequence; identical to SEQ ID NO: 25
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (19)..(19): PEGylated
  MOD_RES (31)..(31): AMIDATION

SEQ ID NO: 792-793 - skipped (2 entries)

SEQ ID NO: 794 - protein, 31 aa, Artificial Sequence; identical to SEQ ID NO: 25
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (19)..(19): PEGylated
  MOD_RES (31)..(31): AMIDATION

SEQ ID NO: 795 - skipped

SEQ ID NO: 796 - protein, 31 aa, Artificial Sequence; identical to SEQ ID NO: 23
  CGRP peptide
  MOD_RES (1)..(1): ACETYLATION
  MISC_FEATURE (12)..(12): xaa=citrulline
  MOD_RES (31)..(31): AMIDATION

SEQ ID NO: 797 - protein, 31 aa, Artificial Sequence; identical to SEQ ID NO: 23
  CGRP peptide
  MOD_RES (1)..(1): ACETYLATION
  MISC_FEATURE (12)..(12): xaa=citrulline
  MISC_FEATURE (19)..(19): PEGylated
  MOD_RES (31)..(31): AMIDATION

SEQ ID NO: 798 - protein, 31 aa, Artificial Sequence; identical to SEQ ID NO: 21
  CGRP peptide
  MOD_RES (1)..(1): ACETYLATION
  MISC_FEATURE (5)..(5): xaa=citrulline
  MOD_RES (31)..(31): AMIDATION

SEQ ID NO: 799 - protein, 31 aa, Artificial Sequence; identical to SEQ ID NO: 21
  CGRP peptide
  MOD_RES (1)..(1): ACETYLATION
  MISC_FEATURE (5)..(5): xaa=citrulline
  MISC_FEATURE (19)..(19): PEGylated
  MOD_RES (31)..(31): AMIDATION

SEQ ID NO: 800 - protein, 31 aa, Artificial Sequence
  CGRP peptide
  MOD_RES (1)..(1): ACETYLATION
  MOD_RES (31)..(31): AMIDATION
WVTHRLAGLLSRSGGVVRNCFVPTDVGPFAF

SEQ ID NO: 801 - protein, 31 aa, Artificial Sequence; identical to SEQ ID NO: 800
  CGRP peptide
  MOD_RES (1)..(1): ACETYLATION
  MISC_FEATURE (20)..(20): PEGylated
  MOD_RES (31)..(31): AMIDATION

SEQ ID NO: 802 - protein, 31 aa, Artificial Sequence; identical to SEQ ID NO: 7
  CGRP peptide
  MOD_RES (1)..(1): ACETYLATION, 13C1,2
  MOD_RES (31)..(31): AMIDATION
  MISC_FEATURE (31)..(31): N15 Isotope

SEQ ID NO: 803 - protein, 31 aa, Artificial Sequence; identical to SEQ ID NO: 7
  CGRP peptide
  MOD_RES (1)..(1): ACETYLATION, 13C1,2
  MISC_FEATURE (19)..(19): PEGylated
  MOD_RES (31)..(31): AMIDATION
  MISC_FEATURE (31)..(31): N15 Isotope

SEQ ID NO: 804 - skipped

SEQ ID NO: 805 - protein, 31 aa, Artificial Sequence; identical to SEQ ID NO: 8
  CGRP peptide
  MOD_RES (1)..(1): ACETYLATION
  MISC_FEATURE (19)..(19): PEGylated
  MOD_RES (31)..(31): AMIDATION

SEQ ID NO: 806 - skipped

SEQ ID NO: 807 - protein, 31 aa, Artificial Sequence; identical to SEQ ID NO: 7
  CGRP peptide
  MOD_RES (1)..(1): ACETYLATION
  MISC_FEATURE (19)..(19): PEGylated
  MOD_RES (31)..(31): AMIDATION

SEQ ID NO: 808 - protein, 31 aa, Artificial Sequence; identical to SEQ ID NO: 7
  CGRP peptide
  MOD_RES (1)..(1): ACETYLATION
  MOD_RES (31)..(31): AMIDATION

SEQ ID NO: 809 - protein, 31 aa, Artificial Sequence; identical to SEQ ID NO: 7
  dup of 677, 810, 811, 812, 813
  MOD_RES (1)..(1): ACETYLATION
  MISC_FEATURE (19)..(19): PEGylated
  MOD_RES (31)..(31): AMIDATION

SEQ ID NO: 810-813 - skipped (4 entries)

SEQ ID NO: 814 - protein, 31 aa, Artificial Sequence; identical to SEQ ID NO: 37
  CGRP peptide
  MOD_RES (1)..(1): ACETYLATION
  MOD_RES (31)..(31): AMIDATION

SEQ ID NO: 815 - protein, 31 aa, Artificial Sequence; identical to SEQ ID NO: 37
  CGRP peptide
  MOD_RES (1)..(1): ACETYLATION
  MISC_FEATURE (19)..(19): PEGylated
  MOD_RES (31)..(31): AMIDATION

SEQ ID NO: 816 - protein, 31 aa, Artificial Sequence; identical to SEQ ID NO: 39
  CGRP peptide
  MOD_RES (1)..(1): ACETYLATION
  MOD_RES (31)..(31): AMIDATION

SEQ ID NO: 817 - protein, 31 aa, Artificial Sequence; identical to SEQ ID NO: 39
  CGRP peptide
  MOD_RES (1)..(1): ACETYLATION
  MISC_FEATURE (19)..(19): PEGylated
  MOD_RES (31)..(31): AMIDATION

SEQ ID NO: 818 - protein, 31 aa, Artificial Sequence; identical to SEQ ID NO: 39
  dup of 817 and 819
  MOD_RES (1)..(1): ACETYLATION
  MISC_FEATURE (19)..(19): PEGylated
  MOD_RES (31)..(31): AMIDATION

SEQ ID NO: 819 - skipped

SEQ ID NO: 820 - protein, 31 aa, Artificial Sequence; identical to SEQ ID NO: 10
  CGRP peptide
  MOD_RES (1)..(1): ACETYLATION
  MOD_RES (31)..(31): AMIDATION

SEQ ID NO: 821 - protein, 31 aa, Artificial Sequence; identical to SEQ ID NO: 10
  CGRP peptide
  MOD_RES (1)..(1): ACETYLATION
  MISC_FEATURE (17)..(17): PEGylated
  MOD_RES (31)..(31): AMIDATION

SEQ ID NO: 822 - skipped

SEQ ID NO: 823 - protein, 31 aa, Artificial Sequence; identical to SEQ ID NO: 11
  CGRP peptide
  MOD_RES (1)..(1): ACETYLATION
  MOD_RES (31)..(31): AMIDATION

SEQ ID NO: 824 - protein, 31 aa, Artificial Sequence; identical to SEQ ID NO: 11
  CGRP peptide
  MOD_RES (1)..(1): ACETYLATION
  MISC_FEATURE (17)..(17): PEGylated
  MOD_RES (31)..(31): AMIDATION

SEQ ID NO: 825-827 - skipped (3 entries)

SEQ ID NO: 828 - protein, 31 aa, Artificial Sequence
  CGRP peptide
  MOD_RES (1)..(1): ACETYLATION
  MOD_RES (31)..(31): AMIDATION
WVTHRLAGLVSQSGGVCRNNFVPTDVGPFAF

SEQ ID NO: 829 - protein, 31 aa, Artificial Sequence; identical to SEQ ID NO: 828
  CGRP peptide
  MOD_RES (1)..(1): ACETYLATION
  MISC_FEATURE (17)..(17): PEGylated
  MOD_RES (31)..(31): AMIDATION

SEQ ID NO: 830 - protein, 31 aa, Artificial Sequence
  CGRP peptide
  MOD_RES (1)..(1): ACETYLATION
  MISC_FEATURE (10)..(10): xaa=norvaline
  MOD_RES (31)..(31): AMIDATION
WVTHRLAGLXSQSGGVCRNNFVPTDVGPFAF

SEQ ID NO: 831 - protein, 31 aa, Artificial Sequence; identical to SEQ ID NO: 830
  CGRP peptide
  MOD_RES (1)..(1): ACETYLATION
  MISC_FEATURE (10)..(10): xaa=norvaline
  MISC_FEATURE (17)..(17): PEGylated
  MOD_RES (31)..(31): AMIDATION

SEQ ID NO: 832 - protein, 31 aa, Artificial Sequence
  CGRP peptide
  MOD_RES (1)..(1): ACETYLATION
  MOD_RES (31)..(31): AMIDATION
WVTHQLAGLVSQSGGVCRNNFVPTDVGPFAF

SEQ ID NO: 833 - protein, 31 aa, Artificial Sequence
  CGRP peptide
  MOD_RES (1)..(1): ACETYLATION
  MISC_FEATURE (10)..(10): xaa=norvaline
  MOD_RES (31)..(31): AMIDATION
WVTHQLAGLXSQSGGVCRNNFVPTDVGPFAF

SEQ ID NO: 834 - protein, 31 aa, Artificial Sequence; identical to SEQ ID NO: 833
  CGRP peptide
  MOD_RES (1)..(1): ACETYLATION
  MISC_FEATURE (10)..(10): xaa=norvaline
  MISC_FEATURE (17)..(17): PEGylated
  MOD_RES (31)..(31): AMIDATION

SEQ ID NO: 835 - protein, 31 aa, Artificial Sequence
  CGRP peptide
  MOD_RES (1)..(1): ACETYLATION
  MISC_FEATURE (12)..(12): xaa=citrulline
  MOD_RES (31)..(31): AMIDATION
WVTHRLAGLVSXSGGVCRNNFVPTDVGPFAF

SEQ ID NO: 836 - protein, 31 aa, Artificial Sequence; identical to SEQ ID NO: 835
  CGRP peptide
  MOD_RES (1)..(1): ACETYLATION
  MISC_FEATURE (12)..(12): xaa=citrulline
  MISC_FEATURE (17)..(17): PEGylated
  MOD_RES (31)..(31): AMIDATION

SEQ ID NO: 837 - protein, 31 aa, Artificial Sequence
  CGRP peptide
  MOD_RES (1)..(1): ACETYLATION
  MISC_FEATURE (10)..(10): xaa=norvaline
  MISC_FEATURE (12)..(12): xaa=citrulline
  MOD_RES (31)..(31): AMIDATION
WVTHRLAGLXSXSGGVCRNNFVPTDVGPFAF

SEQ ID NO: 838 - protein, 31 aa, Artificial Sequence; identical to SEQ ID NO: 837
  CGRP peptide
  MOD_RES (1)..(1): ACETYLATION
  MISC_FEATURE (10)..(10): xaa=norvaline
  MISC_FEATURE (12)..(12): xaa=citrulline
  MISC_FEATURE (17)..(17): PEGylated
  MOD_RES (31)..(31): AMIDATION

SEQ ID NO: 839 - protein, 31 aa, Artificial Sequence
  CGRP peptide
  MOD_RES (1)..(1): ACETYLATION
  MISC_FEATURE (5)..(5): xaa=citrulline
  MISC_FEATURE (12)..(12): xaa=citrulline
  MOD_RES (31)..(31): AMIDATION
WVTHXLAGLVSXSGGVCRNNFVPTDVGPFAF

SEQ ID NO: 840 - protein, 31 aa, Artificial Sequence; identical to SEQ ID NO: 839
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (17)..(17): PEGylated
  MOD_RES (31)..(31): AMIDATION

SEQ ID NO: 841 - protein, 31 aa, Artificial Sequence
  CGRP peptide
  MOD_RES (1)..(1): ACETYLATION
  MISC_FEATURE (5)..(5): xaa=citrulline
  MISC_FEATURE (10)..(10): xaa=norvaline
  MISC_FEATURE (12)..(12): xaa=citrulline
  MOD_RES (31)..(31): AMIDATION
WVTHXLAGLXSXSGGVCRNNFVPTDVGPFAF

SEQ ID NO: 842 - protein, 31 aa, Artificial Sequence; identical to SEQ ID NO: 841
  CGRP peptide
  MOD_RES (1)..(1): ACETYLATION
  MISC_FEATURE (5)..(5): xaa=citrulline
  MISC_FEATURE (10)..(10): xaa=norvaline
  MISC_FEATURE (12)..(12): xaa=citrulline
  MISC_FEATURE (17)..(17): PEGylated
  MOD_RES (31)..(31): AMIDATION

SEQ ID NO: 843 - protein, 31 aa, Artificial Sequence
  CGRP peptide
  MOD_RES (1)..(1): ACETYLATION
  MOD_RES (31)..(31): AMIDATION
WVTHQLAGLLSQSGGVCRNNFVPTDVGPFAF

SEQ ID NO: 844 - protein, 31 aa, Artificial Sequence; identical to SEQ ID NO: 843
  CGRP peptide
  MOD_RES (1)..(1): ACETYLATION
  MISC_FEATURE (17)..(17): PEGylated
  MOD_RES (31)..(31): AMIDATION

SEQ ID NO: 845 - protein, 31 aa, Artificial Sequence
  CGRP peptide
  MOD_RES (1)..(1): ACETYLATION
  MISC_FEATURE (5)..(5): xaa=citrulline
  MISC_FEATURE (12)..(12): xaa=citrulline
  MOD_RES (31)..(31): AMIDATION
WVTHXLAGLLSXSGGVCRNNFVPTDVGPFAF

SEQ ID NO: 846 - protein, 31 aa, Artificial Sequence; identical to SEQ ID NO: 845
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (17)..(17): PEGylated
  MOD_RES (31)..(31): AMIDATION

SEQ ID NO: 847 - protein, 31 aa, Artificial Sequence
  CGRP peptide
  MOD_RES (1)..(1): ACETYLATION
  MISC_FEATURE (12)..(12): xaa=citrulline
  MOD_RES (31)..(31): AMIDATION
WVTHRLAGLLSXSGGVCRKNFVPTDVGPFAF

SEQ ID NO: 848 - protein, 31 aa, Artificial Sequence
  CGRP peptide
  MOD_RES (1)..(1): ACETYLATION
  MOD_RES (31)..(31): AMIDATION
WVTHRLAGLASRSGGVVRKNFVPTDVGPFAF

SEQ ID NO: 849 - protein, 31 aa, Artificial Sequence; identical to SEQ ID NO: 848
  CGRP peptide
  MOD_RES (1)..(1): ACETYLATION
  MISC_FEATURE (19)..(19): PEGylated
  MOD_RES (31)..(31): AMIDATION

SEQ ID NO: 850 - protein, 31 aa, Artificial Sequence
  CGRP peptide
  MOD_RES (1)..(1): ACETYLATION
  MISC_FEATURE (12)..(12): xaa=citrulline
  MOD_RES (31)..(31): AMIDATION
WVTHRLAGLASXSGGVVRKNFVPTDVGPFAF

SEQ ID NO: 851 - protein, 31 aa, Artificial Sequence; identical to SEQ ID NO: 850
  CGRP peptide
  MOD_RES (1)..(1): ACETYLATION
  MISC_FEATURE (12)..(12): xaa=citrulline
  MISC_FEATURE (19)..(19): PEGylated
  MOD_RES (31)..(31): AMIDATION

SEQ ID NO: 852 - protein, 31 aa, Artificial Sequence
  CGRP peptide
  MOD_RES (1)..(1): ACETYLATION
  MISC_FEATURE (5)..(5): xaa=citrulline
  MISC_FEATURE (12)..(12): xaa=citrulline
  MOD_RES (31)..(31): AMIDATION
WVTHXLAGLASXSGGVVRKNFVPTDVGPFAF

SEQ ID NO: 853 - protein, 31 aa, Artificial Sequence; identical to SEQ ID NO: 852
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (19)..(19): PEGylated
  MOD_RES (31)..(31): AMIDATION

SEQ ID NO: 854 - protein, 31 aa, Artificial Sequence
  CGRP peptide
  MOD_RES (1)..(1): ACETYLATION
  MOD_RES (31)..(31): AMIDATION
WVTHRLAGLLSRPGGVVRKNFVPTDVGPFAF

SEQ ID NO: 855 - protein, 31 aa, Artificial Sequence; identical to SEQ ID NO: 854
  CGRP peptide
  MOD_RES (1)..(1): ACETYLATION
  MISC_FEATURE (19)..(19): PEGylated
  MOD_RES (31)..(31): AMIDATION

SEQ ID NO: 856 - protein, 31 aa, Artificial Sequence; identical to SEQ ID NO: 37
  CGRP peptide
  MOD_RES (1)..(1): ACETYLATION
  MOD_RES (31)..(31): AMIDATION

SEQ ID NO: 857 - protein, 31 aa, Artificial Sequence; identical to SEQ ID NO: 39
  CGRP peptide
  MOD_RES (1)..(1): ACETYLATION
  MOD_RES (31)..(31): AMIDATION

SEQ ID NO: 858 - protein, 31 aa, Artificial Sequence; identical to SEQ ID NO: 151
  CGRP peptide
  MOD_RES (1)..(1): ACETYLATION
  MOD_RES (31)..(31): AMIDATION

SEQ ID NO: 859 - protein, 31 aa, Artificial Sequence; identical to SEQ ID NO: 147
  CGRP peptide
  MOD_RES (1)..(1): ACETYLATION
  MOD_RES (31)..(31): AMIDATION

SEQ ID NO: 860 - protein, 31 aa, Artificial Sequence; identical to SEQ ID NO: 854
  CGRP peptide
  MOD_RES (1)..(1): ACETYLATION
  MOD_RES (31)..(31): AMIDATION

SEQ ID NO: 861 - protein, 31 aa, Artificial Sequence; identical to SEQ ID NO: 21
  CGRP peptide
  MOD_RES (1)..(1): ACETYLATION
  MISC_FEATURE (5)..(5): xaa=citrulline
  MOD_RES (31)..(31): AMIDATION

SEQ ID NO: 862 - protein, 31 aa, Artificial Sequence; identical to SEQ ID NO: 23
  CGRP peptide
  MOD_RES (1)..(1): ACETYLATION
  MISC_FEATURE (12)..(12): xaa=citrulline
  MOD_RES (31)..(31): AMIDATION

SEQ ID NO: 863 - skipped

SEQ ID NO: 864 - protein, 31 aa, Artificial Sequence; identical to SEQ ID NO: 23
  CGRP peptide
  MOD_RES (1)..(1): ACETYLATION
  MISC_FEATURE (12)..(12): xaa=homoarginine
  MOD_RES (31)..(31): AMIDATION

SEQ ID NO: 865 - protein, 31 aa, Artificial Sequence; identical to SEQ ID NO: 21
  CGRP peptide
  MOD_RES (1)..(1): ACETYLATION
  MISC_FEATURE (5)..(5): xaa=homoarginine
  MOD_RES (31)..(31): AMIDATION

SEQ ID NO: 866 - protein, 31 aa, Artificial Sequence; identical to SEQ ID NO: 25
  CGRP peptide
  MOD_RES (1)..(1): ACETYLATION
  MISC_FEATURE (5)..(5): xaa=homoarginine
  MISC_FEATURE (12)..(12): xaa=homoarginine
  MOD_RES (31)..(31): AMIDATION

SEQ ID NO: 867 - protein, 31 aa, Artificial Sequence; identical to SEQ ID NO: 150
  CGRP peptide
  MOD_RES (1)..(1): ACETYLATION
  MISC_FEATURE (5)..(5): xaa=citrulline
  MOD_RES (31)..(31): AMIDATION

SEQ ID NO: 868 - protein, 31 aa, Artificial Sequence; identical to SEQ ID NO: 149
  CGRP peptide
  MOD_RES (1)..(1): ACETYLATION
  MISC_FEATURE (5)..(5): xaa=citrulline
  MOD_RES (31)..(31): AMIDATION

SEQ ID NO: 869 - protein, 31 aa, Artificial Sequence; identical to SEQ ID NO: 148
  CGRP peptide
  MOD_RES (1)..(1): ACETYLATION
  MISC_FEATURE (5)..(5): xaa=citrulline
  MOD_RES (31)..(31): AMIDATION

SEQ ID NO: 870 - protein, 31 aa, Artificial Sequence; identical to SEQ ID NO: 852
  CGRP peptide
  MOD_RES (1)..(1): ACETYLATION
  MISC_FEATURE (5)..(5): xaa=citrulline
  MISC_FEATURE (12)..(12): xaa=citrulline
  MOD_RES (31)..(31): AMIDATION

SEQ ID NO: 871 - protein, 31 aa, Artificial Sequence; identical to SEQ ID NO: 71
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MOD_RES (31)..(31): AMIDATION

SEQ ID NO: 872 - protein, 31 aa, Artificial Sequence
  CGRP peptide
  MOD_RES (1)..(1): ACETYLATION
  MISC_FEATURE (1)..(1): xaa=3-(1-naphthyl)alanine
  MISC_FEATURE (5)..(5): xaa=citrulline
  MISC_FEATURE (12)..(12): xaa=citrulline
  MOD_RES (31)..(31): AMIDATION
XVTHXLAGLLSXSGGVVRKNFVPTDVGPFAF

SEQ ID NO: 873 - protein, 31 aa, Artificial Sequence
  CGRP peptide
  MOD_RES (1)..(1): ACETYLATION
  MISC_FEATURE (5)..(5): xaa=citrulline
  MISC_FEATURE (6)..(6): xaa=norvaline
  MISC_FEATURE (9)..(9): xaa=norvaline
  MISC_FEATURE (10)..(10): xaa=norvaline
  MISC_FEATURE (12)..(12): xaa=citrulline
  MOD_RES (31)..(31): AMIDATION
WVTHXXAGXXTXSGGVVRKNFVPTDVGPFAF

SEQ ID NO: 874 - protein, 31 aa, Artificial Sequence
  CGRP peptide
  MOD_RES (1)..(1): ACETYLATION
  MISC_FEATURE (6)..(6): xaa=Nalpha-methyl leucine
  MISC_FEATURE (13)..(13): xaa=Nalpha-methyl serine
  MOD_RES (31)..(31): AMIDATION
WVTHRXAGLLSRXGGVVRKNFVPTDVGPFAF

SEQ ID NO: 875 - protein, 31 aa, Artificial Sequence; identical to SEQ ID NO: 25
  CGRP peptide
  MOD_RES (1)..(1): ACETYLATION
  MISC_FEATURE (5)..(5): xaa=Nalpha-methyl arginine
  MISC_FEATURE (12)..(12): xaa=Nalpha-methyl arginine
  MOD_RES (31)..(31): AMIDATION

SEQ ID NO: 876 - protein, 31 aa, Artificial Sequence
  CGRP peptide
  MOD_RES (1)..(1): ACETYLATION
  MISC_FEATURE (23)..(23): xaa=1,2,3,4-L-Tetrahydroisoquinoline-3-Carboxylic acid
  MOD_RES (31)..(31): AMIDATION
WVTHRLAGLLSRSGGVVRKNFVXTDVGPFAF

SEQ ID NO: 877 - protein, 31 aa, Artificial Sequence; identical to SEQ ID NO: 326
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (23)..(23): xaa=hydroxy proline
  MOD_RES (31)..(31): AMIDATION

SEQ ID NO: 878 - protein, 31 aa, Artificial Sequence; identical to SEQ ID NO: 326
  CGRP peptide
  MOD_RES (1)..(1): ACETYLATION
  MISC_FEATURE (5)..(5): xaa=homocitrulline
  MISC_FEATURE (12)..(12): xaa=homocitrulline
  MISC_FEATURE (23)..(23): xaa=1,2,3,4-L-Tetrahydroisoquinoline-3-Carboxylic acid
  MOD_RES (31)..(31): ACETYLATION

SEQ ID NO: 879 - protein, 31 aa, Artificial Sequence; identical to SEQ ID NO: 876
  CGRP peptide
  MOD_RES (1)..(1): ACETYLATION
  MISC_FEATURE (23)..(23): xaa=aminoisobutyric acid
  MOD_RES (31)..(31): AMIDATION

SEQ ID NO: 880 - protein, 31 aa, Artificial Sequence; identical to SEQ ID NO: 71
  CGRP peptide
  MOD_RES (1)..(1): ACETYLATION
  MISC_FEATURE (5)..(5): xaa=citrulline
  MISC_FEATURE (12)..(12): xaa=homoarginine
  MISC_FEATURE (18)..(18): xaa=homoarginine
  MOD_RES (31)..(31): AMIDATION

SEQ ID NO: 881 - protein, 28 aa, Artificial Sequence
  CGRP peptide
  MOD_RES (1)..(1): ACETYLATION
  MISC_FEATURE (5)..(5): xaa=homoarginine
  MISC_FEATURE (12)..(12): xaa=citrulline
  MISC_FEATURE (18)..(18): xaa=homoarginine
  MOD_RES (28)..(28): AMIDATION
WVTHXLAGLLSXSGGVVXKNFVPTDVGP

SEQ ID NO: 882 - protein, 31 aa, Artificial Sequence; identical to SEQ ID NO: 71
  CGRP peptide
  MOD_RES (1)..(1): ACETYLATION
  MISC_FEATURE (5)..(5): xaa=homoarginine
  MISC_FEATURE (12)..(12): xaa=homoarginine
  MISC_FEATURE (18)..(18): xaa=homoarginine
  MOD_RES (31)..(31): AMIDATION

SEQ ID NO: 883 - protein, 31 aa, Artificial Sequence
  CGRP peptide
  MOD_RES (1)..(1): ACETYLATION
  MISC_FEATURE (5)..(5): xaa=citrulline
  MISC_FEATURE (18)..(18): xaa=homoarginine
  MOD_RES (31)..(31): AMIDATION
WVTHXLAGLLSQSGGVVXKNFVPTDVGPFAF

SEQ ID NO: 884 - protein, 31 aa, Artificial Sequence
  CGRP peptide
  MOD_RES (1)..(1): ACETYLATION
  MISC_FEATURE (12)..(12): xaa=citrulline
  MISC_FEATURE (18)..(18): xaa=homoarginine
  MOD_RES (31)..(31): AMIDATION
WVTHQLAGLLSXSGGVVXKNFVPTDVGPFAF

SEQ ID NO: 885 - protein, 31 aa, Artificial Sequence; identical to SEQ ID NO: 152
  CGRP peptide
  MOD_RES (1)..(1): ACETYLATION
  MISC_FEATURE (18)..(18): xaa=homoarginine
  MOD_RES (31)..(31): AMIDATION

SEQ ID NO: 886 - protein, 31 aa, Artificial Sequence; identical to SEQ ID NO: 71
  CGRP peptide
  MOD_RES (1)..(1): ACETYLATION
  MISC_FEATURE (5)..(5): xaa=homocitrulline
  MISC_FEATURE (12)..(12): xaa=homocitrulline
  MISC_FEATURE (18)..(18): xaa=homoarginine
  MOD_RES (31)..(31): AMIDATION

SEQ ID NO: 887 - protein, 31 aa, Artificial Sequence; identical to SEQ ID NO: 71
  CGRP peptide
  MOD_RES (1)..(1): ACETYLATION
  MISC_FEATURE (5)..(5): xaa=homoarginine
  MISC_FEATURE (12)..(12): xaa=homocitrulline
  MISC_FEATURE (18)..(18): xaa=homoarginine
  MOD_RES (31)..(31): AMIDATION

SEQ ID NO: 888 - protein, 31 aa, Artificial Sequence; identical to SEQ ID NO: 71
  CGRP peptide
  MOD_RES (1)..(1): ACETYLATION
  MISC_FEATURE (5)..(5): xaa=homocitrulline
  MISC_FEATURE (12)..(12): xaa=homoarginine
  MISC_FEATURE (18)..(18): xaa=homoarginine
  MOD_RES (31)..(31): AMIDATION

SEQ ID NO: 889 - protein, 31 aa, Artificial Sequence
  CGRP peptide
  MISC_FEATURE: Lactam bridge between residues 9 and 13.
  MOD_RES (1)..(1): ACETYLATION
  MOD_RES (31)..(31): AMIDATION
WVTHRLRGELSRKGGVVRKNFVPTDVGPFAF

SEQ ID NO: 890 - protein, 31 aa, Artificial Sequence
  CGRP peptide
  MISC_FEATURE: Lactam bridge between residues 7 and 11.
  MOD_RES (1)..(1): ACETYLATION
  MOD_RES (31)..(31): AMIDATION
WVEHRLEGLLKRSGGVVRKNFVPTDVGPFAF

SEQ ID NO: 891 - protein, 31 aa, Artificial Sequence
  CGRP peptide
  MISC_FEATURE: Lactam bridge between residues 3 and 7.
  MOD_RES (1)..(1): ACETYLATION
  MOD_RES (31)..(31): AMIDATION
WVEHRLKGLLSRSGGVVRKNFVPTDVGPFAF

SEQ ID NO: 892 - protein, 31 aa, Artificial Sequence
  CGRP peptide
  MISC_FEATURE: Lactam bridge between residues 3 and 7, and between 9 and 13.
  MOD_RES (1)..(1): ACETYLATION
  MOD_RES (31)..(31): AMIDATION
WVEHRLKGELSRKGGVVRKNFVPTDVGPFAF

SEQ ID NO: 893 - protein, 31 aa, Artificial Sequence
  CGRP peptide
  MISC_FEATURE: Lactam bridge between residues 3 and 7.
  MOD_RES (1)..(1): ACETYLATION
  MISC_FEATURE (12)..(12): xaa=citrulline
  MOD_RES (31)..(31): AMIDATION
WVEHRLKGLLSXSGGVVRKNFVPTDVGPFAF

SEQ ID NO: 894 - protein, 31 aa, Artificial Sequence; identical to SEQ ID NO: 155
  CGRP peptide
  MISC_FEATURE: Lactam bridge between residues 3 and 7.
  MOD_RES (1)..(1): ACETYLATION
  MISC_FEATURE (5)..(5): xaa=homoarginine
  MISC_FEATURE (12)..(12): xaa=citrulline
  MOD_RES (31)..(31): AMIDATION

SEQ ID NO: 895 - protein, 31 aa, Artificial Sequence; identical to SEQ ID NO: 893
  CGRP peptide
  MISC_FEATURE: Lactam bridge between residues 3 and 7.
  MOD_RES (1)..(1): ACETYLATION
  MISC_FEATURE (12)..(12): xaa=citrulline
  MOD_RES (31)..(31): AMIDATION

SEQ ID NO: 896 - protein, 31 aa, Artificial Sequence; identical to SEQ ID NO: 893
  CGRP peptide
  MISC_FEATURE: Lactam bridge between residues 3 and 7.
  MOD_RES (1)..(1): ACETYLATION
  MISC_FEATURE (12)..(12): xaa=citrulline
  MOD_RES (31)..(31): AMIDATION

SEQ ID NO: 897 - protein, 31 aa, Artificial Sequence; identical to SEQ ID NO: 105
  CGRP peptide
  MISC_FEATURE: Lactam bridge between residues 3 and 7.
  MOD_RES (1)..(1): ACETYLATION
  MISC_FEATURE (1)..(1): xaa=3-(1-naphthyl)alanine
  MISC_FEATURE (5)..(5): xaa=homoarginine
  MISC_FEATURE (12)..(12): xaa=citrulline
  MOD_RES (31)..(31): AMIDATION

SEQ ID NO: 898 - protein, 32 aa, Artificial Sequence; identical to SEQ ID NO: 106
  CGRP peptide
  MISC_FEATURE: Lactam bridge between residues 4 and 8.
  MOD_RES (1)..(1): ACETYLATION
  MISC_FEATURE (1)..(1): xaa=aminoisobutyric acid
  MISC_FEATURE (6)..(6): xaa=homoarginine
  MISC_FEATURE (13)..(13): xaa=citrulline
  MOD_RES (32)..(32): AMIDATION

SEQ ID NO: 899 - protein, 31 aa, Artificial Sequence
  CGRP peptide
  MISC_FEATURE: Lactam bridge between residues 3 and 7.
  MOD_RES (1)..(1): ACETYLATION
  MISC_FEATURE (5)..(5): xaa=homoarginine
  MISC_FEATURE (12)..(12): xaa=citrulline
  MISC_FEATURE (15)..(15): xaa=azetidine-2-carboxylic acid
  MOD_RES (31)..(31): AMIDATION
WVEHXLKGLLSXSGXVVRKNFVPTDVGPFAF

SEQ ID NO: 900 - protein, 31 aa, Artificial Sequence; identical to SEQ ID NO: 105
  CGRP peptide
  MISC_FEATURE: Lactam bridge between residues 3 and 7.
  MOD_RES (1)..(1): ACETYLATION
  MISC_FEATURE (1)..(1): xaa=3-(1-naphthyl)alanine
  MISC_FEATURE (5)..(5): xaa=homoarginine
  MISC_FEATURE (12)..(12): xaa=citrulline
  MOD_RES (31)..(31): AMIDATION

SEQ ID NO: 901 - protein, 31 aa, Artificial Sequence
  CGRP peptide
  MISC_FEATURE: Lactam bridge between residues 3 and 7 and between 9 and 13.
  MOD_RES (1)..(1): ACETYLATION
  MISC_FEATURE (18)..(18): xaa=homoarginine
  MOD_RES (31)..(31): AMIDATION
WVEHRLKGELSRKGGVVXKNFVPTDVGPFAF

SEQ ID NO: 902 - protein, 31 aa, Artificial Sequence
  CGRP peptide
  MISC_FEATURE: Lactam bridge between residues 3 and 7 and between 9 and 13.
  MOD_RES (1)..(1): ACETYLATION
  MISC_FEATURE (12)..(12): xaa=citrulline
  MISC_FEATURE (18)..(18): xaa=homoarginine
  MOD_RES (31)..(31): AMIDATION
WVEHRLKGELSXKGGVVXKNFVPTDVGPFAF

SEQ ID NO: 903 - protein, 31 aa, Artificial Sequence
  CGRP peptide
  MISC_FEATURE: Lactam bridge between residues 7 and 11.
  MOD_RES (1)..(1): ACETYLATION
  MISC_FEATURE (18)..(18): xaa=homoarginine
  MOD_RES (31)..(31): AMIDATION
WVTHRLEGLLKQSGGVVXKNFVPTDVGPFAF

SEQ ID NO: 904 - protein, 31 aa, Artificial Sequence
  CGRP peptide
  MISC_FEATURE: Lactam bridge between residues 3 and 7.
  MOD_RES (1)..(1): ACETYLATION
  MISC_FEATURE (18)..(18): xaa=homoarginine
  MOD_RES (31)..(31): AMIDATION
WVEHRLKGLLSQSGGVVXKNFVPTDVGPFAF

SEQ ID NO: 905 - protein, 31 aa, Artificial Sequence; identical to SEQ ID NO: 663
  CGRP peptide
  MISC_FEATURE: Lactam bridge between residues 3 and 7.
  MOD_RES (1)..(1): ACETYLATION
  MISC_FEATURE (12)..(12): xaa=homoarginine
  MISC_FEATURE (18)..(18): xaa=homoarginine
  MOD_RES (31)..(31): AMIDATION

SEQ ID NO: 906 - protein, 31 aa, Artificial Sequence; identical to SEQ ID NO: 663
  CGRP peptide
  MISC_FEATURE: Lactam bridge between residues 3 and 7.
  MOD_RES (1)..(1): ACETYLATION
  MISC_FEATURE (12)..(12): xaa=citrulline
  MISC_FEATURE (18)..(18): xaa=homoarginine
  MOD_RES (31)..(31): AMIDATION

SEQ ID NO: 907 - protein, 31 aa, Artificial Sequence
  CGRP peptide
  MISC_FEATURE: Lactam bridge between residues 3 and 7.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MOD_RES (31)..(31): AMIDATION
WVEHXLKGLLSXSGGVVXKNFVPTDVGPFAF

SEQ ID NO: 908 - protein, 31 aa, Artificial Sequence; identical to SEQ ID NO: 907
  CGRP peptide
  MISC_FEATURE: Lactam bridge between residues 3 and 7.
  MOD_RES (1)..(1): ACETYLATION
  MISC_FEATURE (5)..(5): xaa=homoarginine
  MISC_FEATURE (12)..(12): xaa=citrulline
  MISC_FEATURE (18)..(18): xaa=homoarginine
  MOD_RES (31)..(31): AMIDATION

SEQ ID NO: 909 - protein, 31 aa, Artificial Sequence
  CGRP peptide
  MISC_FEATURE: Lactam bridge between residues 3 and 7.
  MOD_RES (1)..(1): ACETYLATION
  MISC_FEATURE (5)..(5): xaa=homoarginine
  MISC_FEATURE (12)..(12): xaa=citrulline
  MISC_FEATURE (15)..(15): xaa=azetidine-2-carboxylic acid (Aze)
  MISC_FEATURE (18)..(18): xaa=homoarginine
  MOD_RES (31)..(31): AMIDATION
WVEHXLKGLLSXSGXVVXKNFVPTDVGPFAF

SEQ ID NO: 910 - protein, 31 aa, Artificial Sequence
  CGRP peptide
  MOD_RES (1)..(1): ACETYLATION
  MISC_FEATURE (1)..(1): xaa=3-(1-naphthyl)alanine
  MISC_FEATURE (5)..(5): xaa=homoarginine
  MISC_FEATURE (12)..(12): xaa=citrulline
  MISC_FEATURE (15)..(15): xaa=azetidine-2-carboxylic acid (Aze)
  MISC_FEATURE (18)..(18): xaa=homoarginine
  MOD_RES (31)..(31): AMIDATION
XVEHXLKGLLSXSGXVVXKNFVPTDVGPFAF

SEQ ID NO: 911 - protein, 31 aa, Artificial Sequence; identical to SEQ ID NO: 907
  CGRP peptide
  MISC_FEATURE: Lactam bridge between residues 3 and 7.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MOD_RES (31)..(31): AMIDATION

SEQ ID NO: 912 - protein, 31 aa, Artificial Sequence; identical to SEQ ID NO: 319
  CGRP peptide
  MOD_RES (1)..(1): ACETYLATION
  MISC_FEATURE (21)..(21): xaa=3-(2-naphthyl)alanine
  MOD_RES (31)..(31): AMIDATION

SEQ ID NO: 913 - protein, 31 aa, Artificial Sequence; identical to SEQ ID NO: 320
  CGRP peptide
  MOD_RES (1)..(1): ACETYLATION
  MOD_RES (31)..(31): AMIDATION
  MISC_FEATURE (31)..(31): xaa=3-(2-naphthyl)alanine

SEQ ID NO: 914 - protein, 31 aa, Artificial Sequence; identical to SEQ ID NO: 320
  CGRP peptide
  MOD_RES (1)..(1): ACETYLATION
  MOD_RES (31)..(31): AMIDATION
  MISC_FEATURE (31)..(31): xaa=3-(1-naphthyl)alanine

SEQ ID NO: 915 - protein, 31 aa, Artificial Sequence; identical to SEQ ID NO: 322
  CGRP peptide
  MOD_RES (1)..(1): ACETYLATION
  MOD_RES (31)..(31): AMIDATION

SEQ ID NO: 916 - protein, 33 aa, Artificial Sequence; identical to SEQ ID NO: 323
  CGRP peptide
  MISC_FEATURE (2)..(2): xaa=6-aminohexanoic acid
  MOD_RES (33)..(33): AMIDATION

SEQ ID NO: 917 - protein, 31 aa, Artificial Sequence; identical to SEQ ID NO: 324
  CGRP peptide
  MOD_RES (1)..(1): ACETYLATION
  MOD_RES (31)..(31): AMIDATION

SEQ ID NO: 918 - protein, 31 aa, Artificial Sequence; identical to SEQ ID NO: 325
  CGRP peptide
  MOD_RES (1)..(1): ACETYLATION
  MISC_FEATURE (5)..(5): xaa=citrulline
  MISC_FEATURE (12)..(12): xaa=citrulline
  MOD_RES (31)..(31): AMIDATION

SEQ ID NO: 919 - protein, 31 aa, Artificial Sequence; identical to SEQ ID NO: 326
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (23)..(23): xaa=Octahydroindole-2-Carboxylic Acid
  MOD_RES (31)..(31): AMIDATION

SEQ ID NO: 920 - protein, 31 aa, Artificial Sequence; identical to SEQ ID NO: 140
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (28)..(28): xaa=Octahydroindole-2-Carboxylic Acid
  MOD_RES (31)..(31): AMIDATION

SEQ ID NO: 921 - protein, 31 aa, Artificial Sequence; identical to SEQ ID NO: 328
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (23)..(23): xaa=Octahydroindole-2-Carboxylic Acid
  MISC_FEATURE (28)..(28): xaa=Octahydroindole-2-Carboxylic Acid
  MOD_RES (31)..(31): AMIDATION

SEQ ID NO: 922 - protein, 31 aa, Artificial Sequence; identical to SEQ ID NO: 329
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (21)..(21): xaa=4-iodophenylalanine
  MOD_RES (31)..(31): AMIDATION
  MISC_FEATURE (31)..(31): xaa=4-iodophenylalanine

SEQ ID NO: 923 - protein, 31 aa, Artificial Sequence; identical to SEQ ID NO: 330
  CGRP peptide
  MOD_RES (1)..(1): ACETYLATION
  MISC_FEATURE (5)..(5): xaa=citrulline
  MISC_FEATURE (12)..(12): xaa=citrulline
  MOD_RES (31)..(31): AMIDATION
  MISC_FEATURE (31)..(31): xaa=4-iodophenylalanine

SEQ ID NO: 924 - protein, 31 aa, Artificial Sequence; identical to SEQ ID NO: 131
  CGRP peptide
  MOD_RES (1)..(1): ACETYLATION
  MISC_FEATURE (5)..(5): xaa=homoarginine
  MISC_FEATURE (12)..(12): xaa=citrulline
  MISC_FEATURE (18)..(18): xaa=homoarginine
  MISC_FEATURE (29)..(29): xaa=3-(1-naphthyl)alanine
  MOD_RES (31)..(31): AMIDATION

SEQ ID NO: 925 - protein, 31 aa, Artificial Sequence; identical to SEQ ID NO: 332
  CGRP peptide
  MOD_RES (1)..(1): ACETYLATION
  MISC_FEATURE (5)..(5): xaa=homoarginine
  MISC_FEATURE (12)..(12): xaa=citrulline
  MISC_FEATURE (18)..(18): xaa=homoarginine
  MOD_RES (31)..(31): AMIDATION
  MISC_FEATURE (31)..(31): xaa=phenylglycine

SEQ ID NO: 926 - protein, 31 aa, Artificial Sequence; identical to SEQ ID NO: 131
  CGRP peptide
  MOD_RES (1)..(1): ACETYLATION
  MISC_FEATURE (5)..(5): xaa=homoarginine
  MISC_FEATURE (12)..(12): xaa=citrulline
  MISC_FEATURE (18)..(18): xaa=homoarginine
  MISC_FEATURE (29)..(29): xaa=3-(2-naphthyl)alanine
  MOD_RES (31)..(31): AMIDATION

SEQ ID NO: 927 - protein, 31 aa, Artificial Sequence; identical to SEQ ID NO: 131
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (29)..(29): xaa=3-(1-naphthyl)alanine
  MOD_RES (31)..(31): AMIDATION

SEQ ID NO: 928 - protein, 31 aa, Artificial Sequence; identical to SEQ ID NO: 178
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (21)..(21): xaa=4-iodophenylalanine
  MISC_FEATURE (29)..(29): xaa=4-iodophenylalanine
  MOD_RES (31)..(31): AMIDATION

SEQ ID NO: 929 - protein, 31 aa, Artificial Sequence; identical to SEQ ID NO: 131
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (29)..(29): xaa=4,4'-biphenyl alanine
  MOD_RES (31)..(31): AMIDATION

SEQ ID NO: 930 - protein, 31 aa, Artificial Sequence; identical to SEQ ID NO: 131
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (29)..(29): xaa=Indanyl glycine
  MOD_RES (31)..(31): AMIDATION

SEQ ID NO: 931 - protein, 31 aa, Artificial Sequence; identical to SEQ ID NO: 130
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION

SEQ ID NO: 932 - protein, 31 aa, Artificial Sequence; identical to SEQ ID NO: 339
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (23)..(23): xaa=Octahydroindole-2-Carboxylic Acid
  MISC_FEATURE (28)..(28): xaa=Octahydroindole-2-Carboxylic Acid
  MOD_RES (31)..(31): AMIDATION

SEQ ID NO: 933 - protein, 31 aa, Artificial Sequence; identical to SEQ ID NO: 283
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MISC_FEATURE (29)..(29): xaa=3-(1-naphthyl)alanine
  MOD_RES (31)..(31): AMIDATION

SEQ ID NO: 934 - protein, 31 aa, Artificial Sequence; identical to SEQ ID NO: 283
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MISC_FEATURE (29)..(29): xaa=3-(2-naphthyl)alanine
  MOD_RES (31)..(31): AMIDATION

SEQ ID NO: 935 - protein, 31 aa, Artificial Sequence; identical to SEQ ID NO: 71
  CGRP peptide
  MOD_RES (1)..(1): ACETYLATION
  MISC_FEATURE (5)..(5): xaa=citrulline
  MISC_FEATURE (12)..(12): xaa=homoarginine
  MISC_FEATURE (18)..(18): xaa=4-guanidinyl phenylalanine
  MOD_RES (31)..(31): AMIDATION

SEQ ID NO: 936 - protein, 31 aa, Artificial Sequence; identical to SEQ ID NO: 71
  CGRP peptide
  MOD_RES (1)..(1): ACETYLATION
  MISC_FEATURE (5)..(5): xaa=citrulline
  MISC_FEATURE (12)..(12): xaa=homoarginine
  MISC_FEATURE (18)..(18): xaa=beta-homoarginine
  MOD_RES (31)..(31): AMIDATION

SEQ ID NO: 937 - protein, 31 aa, Artificial Sequence; identical to SEQ ID NO: 71
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=citrulline
  MOD_RES (31)..(31): AMIDATION

SEQ ID NO: 938 - protein, 31 aa, Artificial Sequence; identical to SEQ ID NO: 71
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=2-amino-3-guanidinopropanoic acid
  MOD_RES (31)..(31): AMIDATION

SEQ ID NO: 939 - skipped

SEQ ID NO: 940 - protein, 31 aa, Artificial Sequence; identical to SEQ ID NO: 347
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (17)..(17): xaa=norleucine
  MOD_RES (31)..(31): AMIDATION

SEQ ID NO: 941 - protein, 31 aa, Artificial Sequence; identical to SEQ ID NO: 71
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (19)..(19): PEGylated
  MOD_RES (31)..(31): AMIDATION

SEQ ID NO: 942 - protein, 31 aa, Artificial Sequence; identical to SEQ ID NO: 268
  CGRP peptide
  MISC_FEATURE: Lactam bridge between residues 3 and 7.
  MOD_RES (1)..(1): ACETYLATION
  MISC_FEATURE (5)..(5): xaa=homoarginine
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION

SEQ ID NO: 943 - protein, 31 aa, Artificial Sequence; identical to SEQ ID NO: 129
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION

SEQ ID NO: 944 - protein, 31 aa, Artificial Sequence
  CGRP peptide
  MISC_FEATURE: Lactam bridge between residues 9 and 13.
  MOD_RES (1)..(1): ACETYLATION
  MISC_FEATURE (5)..(5): xaa=citrulline
  MISC_FEATURE (12)..(12): xaa=homoarginine
  MISC_FEATURE (18)..(18): xaa=homoarginine
  MISC_FEATURE (28)..(28): xaa=Octahydroindole-2-Carboxylic Acid
  MISC_FEATURE (29)..(29): xaa=3-(1-naphthyl)alanine
  MOD_RES (31)..(31): AMIDATION
WVTHXLAGELSXKGGVVXKNFVPTDVGXXAF

SEQ ID NO: 945 - protein, 32 aa, Artificial Sequence; identical to SEQ ID NO: 128
  CGRP peptide
  MOD_RES (1)..(1): ACETYLATION
  MISC_FEATURE (6)..(6): xaa=citrulline
  MISC_FEATURE (13)..(13): xaa=citrulline
  MOD_RES (32)..(32): AMIDATION

SEQ ID NO: 946 - protein, 31 aa, Artificial Sequence; identical to SEQ ID NO: 130
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=h1,2,3,4-L-Tetrahydroisoquinoline-3-Carboxylic acid
  MOD_RES (31)..(31): AMIDATION

SEQ ID NO: 947 - protein, 31 aa, Artificial Sequence; identical to SEQ ID NO: 131
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (29)..(29): xaa=1,2,3,4-L-Tetrahydroisoquinoline-3-Carboxylic acid
  MOD_RES (31)..(31): AMIDATION

SEQ ID NO: 948 - protein, 31 aa, Artificial Sequence; identical to SEQ ID NO: 132
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (23)..(23): xaa=Octahydroindole-2-Carboxylic Acid
  MISC_FEATURE (28)..(28): xaa=Octahydroindole-2-Carboxylic Acid
  MOD_RES (31)..(31): AMIDATION
  MISC_FEATURE (31)..(31): xaa=3-(2-naphthyl)alanine

SEQ ID NO: 949 - protein, 31 aa, Artificial Sequence; identical to SEQ ID NO: 133
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (23)..(23): xaa=Octahydroindole-2-Carboxylic Acid
  MISC_FEATURE (29)..(29): xaa=3-(1-naphthyl)alanine
  MOD_RES (31)..(31): AMIDATION
  MISC_FEATURE (31)..(31): xaa=3-(2-naphthyl)alanine

SEQ ID NO: 950 - protein, 31 aa, Artificial Sequence; identical to SEQ ID NO: 134
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (23)..(23): xaa=Octahydroindole-2-Carboxylic Acid
  MISC_FEATURE (29)..(29): xaa=4,4'-biphenyl alanine
  MOD_RES (31)..(31): AMIDATION

SEQ ID NO: 951 - protein, 31 aa, Artificial Sequence; identical to SEQ ID NO: 135
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (23)..(23): xaa=Octahydroindole-2-Carboxylic Acid
  MOD_RES (31)..(31): AMIDATION
  MISC_FEATURE (31)..(31): xaa=3-(2-naphthyl)alanine

SEQ ID NO: 952 - protein, 31 aa, Artificial Sequence; identical to SEQ ID NO: 136
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (21)..(21): xaa=4-iodophenylalanine
  MISC_FEATURE (23)..(23): xaa=Octahydroindole-2-Carboxylic Acid
  MISC_FEATURE (29)..(29): xaa=4-iodophenylalanine
  MOD_RES (31)..(31): AMIDATION

SEQ ID NO: 953 - protein, 31 aa, Artificial Sequence; identical to SEQ ID NO: 137
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (21)..(21): xaa=3-(2-naphthyl)alanine
  MISC_FEATURE (28)..(28): xaa=Octahydroindole-2-Carboxylic Acid
  MOD_RES (31)..(31): AMIDATION

SEQ ID NO: 954 - protein, 31 aa, Artificial Sequence; identical to SEQ ID NO: 138
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (21)..(21): xaa=3-(2-naphthyl)alanine
  MISC_FEATURE (28)..(28): xaa=Octahydroindole-2-Carboxylic Acid
  MOD_RES (31)..(31): AMIDATION
  MISC_FEATURE (31)..(31): xaa=3-(2-naphthyl)alanine

SEQ ID NO: 955 - protein, 31 aa, Artificial Sequence; identical to SEQ ID NO: 139
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (21)..(21): xaa=3-(2-naphthyl)alanine
  MISC_FEATURE (23)..(23): xaa=Octahydroindole-2-Carboxylic Acid
  MISC_FEATURE (28)..(28): xaa=Octahydroindole-2-Carboxylic Acid
  MOD_RES (31)..(31): AMIDATION
  MISC_FEATURE (31)..(31): xaa=3-(2-naphthyl)alanine

SEQ ID NO: 956 - protein, 31 aa, Artificial Sequence; identical to SEQ ID NO: 140
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (28)..(28): xaa=1,2,3,4-L-Tetrahydroisoquinoline-3-Carboxylic acid
  MOD_RES (31)..(31): AMIDATION

SEQ ID NO: 957 - protein, 31 aa, Artificial Sequence; identical to SEQ ID NO: 140
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (28)..(28): xaa=1,2,3,4-L-Tetrahydroisoquinoline-3-Carboxylic acid
  MOD_RES (31)..(31): AMIDATION

SEQ ID NO: 958 - protein, 31 aa, Artificial Sequence; identical to SEQ ID NO: 130
  DUP OF 130, 142, 143, 946, AND 959
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=1,2,3,4-L-Tetrahydroisoquinoline-3-Carboxylic acid
  MOD_RES (31)..(31): AMIDATION

SEQ ID NO: 959 - protein, 31 aa, Artificial Sequence; identical to SEQ ID NO: 130
  DUP OF 130, 142, 143, 946, AND 958
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=1,2,3,4-L-Tetrahydroisoquinoline-3-Carboxylic acid
  MOD_RES (31)..(31): AMIDATION

SEQ ID NO: 960 - protein, 31 aa, Artificial Sequence; identical to SEQ ID NO: 131
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (29)..(29): xaa=3-(1-naphthyl)alanine
  MOD_RES (31)..(31): AMIDATION

SEQ ID NO: 961 - protein, 31 aa, Artificial Sequence; identical to SEQ ID NO: 130
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION

SEQ ID NO: 962 - protein, 31 aa, Artificial Sequence; identical to SEQ ID NO: 146
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (29)..(29): xaa=1,2,3,4-L-Tetrahydroisoquinoline-3-Carboxylic acid
  MOD_RES (31)..(31): AMIDATION

SEQ ID NO: 963 - protein, 31 aa, Artificial Sequence; identical to SEQ ID NO: 130
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=1,2,3,4-L-Tetrahydroisoquinoline-1-Carboxylic acid
  MOD_RES (31)..(31): AMIDATION

SEQ ID NO: 964 - protein, 31 aa, Artificial Sequence; identical to SEQ ID NO: 131
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (29)..(29): xaa=1,2,3,4-L-Tetrahydroisoquinoline-1-Carboxylic acid
  MOD_RES (31)..(31): AMIDATION

SEQ ID NO: 965 - skipped

SEQ ID NO: 966 - protein, 32 aa, Artificial Sequence
  CGRP peptide
  MOD_RES (1)..(1): ACETYLATION
  MISC_FEATURE (5)..(5): xaa=citrulline
  MISC_FEATURE (12)..(12): xaa=citrulline
  MOD_RES (32)..(32): AMIDATION
WVTHXLAGLLSXSGGVVRKNFVPTDVGPKAFK

SEQ ID NO: 967-968 - skipped (2 entries)

SEQ ID NO: 969 - protein, 32 aa, Artificial Sequence
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=1,2,3,4-L-Tetrahydroisoquinoline-1-Carboxylic acid
  MOD_RES (32)..(32): AMIDATION
WVTHXLAGLLSXSGGVVXKNFVPTDVGXFAFF

SEQ ID NO: 970 - protein, 32 aa, Artificial Sequence
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (29)..(29): xaa=1,2,3,4-L-Tetrahydroisoquinoline-1-Carboxylic acid
  MOD_RES (32)..(32): AMIDATION
WVTHXLAGLLSXSGGVVXKNFVPTDVGPXAFF

SEQ ID NO: 971 - skipped

SEQ ID NO: 972 - protein, 31 aa, Artificial Sequence; identical to SEQ ID NO: 130
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=phenylglycine
  MOD_RES (31)..(31): AMIDATION

SEQ ID NO: 973-974 - skipped (2 entries)

SEQ ID NO: 975 - protein, 31 aa, Artificial Sequence; identical to SEQ ID NO: 130
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Nipecotic Acid
  MOD_RES (31)..(31): AMIDATION

SEQ ID NO: 976-977 - skipped (2 entries)

SEQ ID NO: 978 - protein, 31 aa, Artificial Sequence; identical to SEQ ID NO: 283
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=hydroxy proline
  MISC_FEATURE (29)..(29): xaa=3-(1-naphthyl)alanine
  MOD_RES (31)..(31): AMIDATION

SEQ ID NO: 979-984 - skipped (6 entries)

SEQ ID NO: 985 - protein, 31 aa, Artificial Sequence; identical to SEQ ID NO: 130
  CGRP peptide
  MOD_RES (1)..(1): ACETYLATION
  MISC_FEATURE (5)..(5): xaa=4-guanidinyl phenylalanine
  MISC_FEATURE (12)..(12): xaa=citrulline
  MISC_FEATURE (18)..(18): xaa=4-guanidinyl phenylalanine
  MISC_FEATURE (28)..(28): xaa=Octahydroindole-2-Carboxylic Acid
  MOD_RES (31)..(31): AMIDATION

SEQ ID NO: 986 - protein, 31 aa, Artificial Sequence; identical to SEQ ID NO: 130
  CGRP peptide
  MOD_RES (1)..(1): ACETYLATION
  MISC_FEATURE (5)..(5): xaa=4-guanidinyl phenylalanine
  MISC_FEATURE (12)..(12): xaa=4-guanidinyl phenylalanine
  MISC_FEATURE (18)..(18): xaa=citrulline
  MISC_FEATURE (28)..(28): xaa=Octahydroindole-2-Carboxylic Acid
  MOD_RES (31)..(31): AMIDATION

SEQ ID NO: 987 - protein, 31 aa, Artificial Sequence; identical to SEQ ID NO: 129
  CGRP peptide
  MISC_FEATURE: Lactam bridge between residues 9 and 13.
  MOD_RES (1)..(1): ACETYLATION
  MISC_FEATURE (5)..(5): xaa=citrulline
  MISC_FEATURE (12)..(12): xaa=homoarginine
  MISC_FEATURE (18)..(18): xaa=4-guanidinyl phenylalanine
  MISC_FEATURE (28)..(28): xaa=Octahydroindole-2-Carboxylic Acid
  MOD_RES (31)..(31): AMIDATION

SEQ ID NO: 988 - protein, 31 aa, Artificial Sequence
  CGRP peptide
  MISC_FEATURE: Lactam bridge between residues 9 and 13.
  MOD_RES (1)..(1): ACETYLATION
  MISC_FEATURE (5)..(5): xaa=citrulline
  MISC_FEATURE (12)..(12): xaa=homoarginine
  MISC_FEATURE (18)..(18): xaa=4-guanidinyl phenylalanine
  MISC_FEATURE (23)..(23): xaa=Octahydroindole-2-Carboxylic Acid
  MISC_FEATURE (28)..(28): xaa=Octahydroindole-2-Carboxylic Acid
  MOD_RES (31)..(31): AMIDATION
WVTHXLAGELSXKGGVVXKNFVXTDVGXFAF

SEQ ID NO: 989-993 - skipped (5 entries)

SEQ ID NO: 994 - protein, 31 aa, Artificial Sequence
  CGRP peptide
  MISC_FEATURE: Lactam bridge between residues 9 and 13.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (29)..(29): xaa=3-(1-naphthyl)alanine
  MOD_RES (31)..(31): AMIDATION
WVTHXLAGELSXKGGVVXKNFVPTDVGPXAF

SEQ ID NO: 995-996 - skipped (2 entries)

SEQ ID NO: 997 - protein, 16 aa, Artificial Sequence
  CGRP peptide
  MOD_RES (1)..(1): ACETYLATION
  MISC_FEATURE (5)..(5): xaa=citrulline
  MISC_FEATURE (12)..(12): xaa=citrulline
  MOD_RES (16)..(16): AMIDATION
WVEHXLKGELSXKGGC

SEQ ID NO: 998 - protein, 16 aa, Artificial Sequence
  CGRP peptide
  MOD_RES (1)..(1): ACETYLATION
  MISC_FEATURE (5)..(5): xaa=citrulline
  MISC_FEATURE (12)..(12): xaa=citrulline
  MOD_RES (16)..(16): AMIDATION
WVEHXLKGLLSXSGGC

SEQ ID NO: 999 - protein, 16 aa, Artificial Sequence
  CGRP peptide
  MOD_RES (1)..(1): ACETYLATION
  MISC_FEATURE (5)..(5): xaa=citrulline
  MISC_FEATURE (12)..(12): xaa=citrulline
  MOD_RES (16)..(16): AMIDATION
WVTHXLEGLLKXSGGC

SEQ ID NO: 1000 - protein, 16 aa, Artificial Sequence
  CGRP peptide
  MOD_RES (1)..(1): ACETYLATION
  MISC_FEATURE (5)..(5): xaa=citrulline
  MISC_FEATURE (12)..(12): xaa=citrulline
  MOD_RES (16)..(16): AMIDATION
WVTHXLAGELSXKGGC

SEQ ID NO: 1001 - protein, 12 aa, Artificial Sequence
  CGRP peptide
  MISC_FEATURE (9)..(9): xaa=Octahydroindole-2-Carboxylic Acid
  MISC_FEATURE (10)..(10): xaa=3-(1-naphthyl)alanine
  MOD_RES (12)..(12): AMIDATION
CGGPTDVGXXAF

SEQ ID NO: 1002 - protein, 12 aa, Artificial Sequence
  CGRP peptide
  MISC_FEATURE (9)..(9): xaa=Octahydroindole-2-Carboxylic Acid
  MISC_FEATURE (10)..(10): xaa=3-(2-naphthyl)alanine
  MOD_RES (12)..(12): AMIDATION
CGGPTDVGXXAF

SEQ ID NO: 1003 - protein, 12 aa, Artificial Sequence
  CGRP peptide
  MISC_FEATURE (9)..(9): xaa=Octahydroindole-2-Carboxylic Acid
  MISC_FEATURE (10)..(10): xaa=3-(2-naphthyl)alanine
  MOD_RES (12)..(12): AMIDATION
  MISC_FEATURE (12)..(12): xaa=3-(2-naphthyl)alanine
CGGPTDVGXXAX

SEQ ID NO: 1004 - protein, 12 aa, Artificial Sequence
  CGRP peptide
  MISC_FEATURE (10)..(10): xaa=3-(1-naphthyl)alanine
  MOD_RES (12)..(12): AMIDATION
CGGPTDVGPXAF

SEQ ID NO: 1005 - protein, 12 aa, Artificial Sequence
  CGRP peptide
  MISC_FEATURE (10)..(10): xaa=3-(2-naphthyl)alanine
  MOD_RES (12)..(12): AMIDATION
CGGPTDVGPXAF

SEQ ID NO: 1006 - protein, 12 aa, Artificial Sequence
  CGRP peptide
  MISC_FEATURE (9)..(9): xaa=Octahydroindole-2-Carboxylic Acid
  MOD_RES (12)..(12): AMIDATION
CGGPTDVGXFAF

SEQ ID NO: 1007 - protein, 12 aa, Artificial Sequence
  CGRP peptide
  MISC_FEATURE (4)..(4): xaa=Octahydroindole-2-Carboxylic Acid
  MISC_FEATURE (9)..(9): xaa=Octahydroindole-2-Carboxylic Acid
  MOD_RES (12)..(12): AMIDATION
CGGXTDVGXFAF

SEQ ID NO: 1008 - protein, 31 aa, Artificial Sequence
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (19)..(19): PEGylated, 3-(2-(2-(2-(2-(2-(2-(2-(2-(2-(2-(2-(2-aminoethoxy)ethoxy)ethoxy)e thoxy)ethoxy)ethoxy)ethoxy)ethoxy)ethoxy)ethoxy)ethoxy)ethoxy)pro panoic acid
  MISC_FEATURE (28)..(28): xaa=Octahydroindole-2-Carboxylic Acid
  MISC_FEATURE (29)..(29): PEGylated
  MOD_RES (31)..(31): AMIDATION
WVTHXLAGLLSXSGGVVXKKFVPTDVGXKAF

SEQ ID NO: 1009 - protein, 31 aa, Artificial Sequence; identical to SEQ ID NO: 665
  CGRP peptide
  MISC_FEATURE (1)..(1): PEGylated, 3-(2-(2-(2-(2-(2-(2-(2-(2-(2-(2-(2-(2-aminoethoxy)ethoxy)ethoxy)e thoxy)ethoxy)ethoxy)ethoxy)ethoxy)ethoxy)ethoxy)ethoxy)ethoxy)pro panoic acid
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION

SEQ ID NO: 1010 - protein, 31 aa, Artificial Sequence
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (21)..(21): xaa=4-guanidinyl phenylalanine
  MISC_FEATURE (28)..(28): xaa=Octahydroindole-2-Carboxylic Acid
  MOD_RES (31)..(31): AMIDATION
WVTHXLAGLLSXSGGVVXKNXVPTDVGXKAF

SEQ ID NO: 1011 - protein, 31 aa, Artificial Sequence; identical to SEQ ID NO: 665
  CGRP peptide
  MISC_FEATURE (1)..(1): PEGylated, 3-(2-(2-(2-(2-(2-(2-(2-(2-(2-(2-(2-(2-aminoethoxy)ethoxy)ethoxy)e thoxy)ethoxy)ethoxy)ethoxy)ethoxy)ethoxy)ethoxy)ethoxy)ethoxy)pro panoic acid
  MISC_FEATURE (1)..(1): Guanidylated
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION

SEQ ID NO: 1012 - protein, 31 aa, Artificial Sequence
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=citrulline
  MISC_FEATURE (19)..(19): PEGylated, 3-(2-(2-(2-(2-(2-(2-(2-(2-(2-(2-(2-(2-aminoethoxy)ethoxy)ethoxy)e thoxy)ethoxy)ethoxy)ethoxy)ethoxy)ethoxy)ethoxy)ethoxy)ethoxy)pro panoic acid
  MISC_FEATURE (28)..(28): xaa=Octahydroindole-2-Carboxylic Acid
  MISC_FEATURE (29)..(29): PEGylated, 3-(2-(2-(2-(2-(2-(2-(2-(2-(2-(2-(2-(2-aminoethoxy)ethoxy)ethoxy)e thoxy)ethoxy)ethoxy)ethoxy)ethoxy)ethoxy)ethoxy)ethoxy)ethoxy)pro panoic acid
  MOD_RES (31)..(31): AMIDATION
WVTHXLAGLLSXSGGVVXKKFVPTNVGXKAF

SEQ ID NO: 1013 - protein, 31 aa, Artificial Sequence; identical to SEQ ID NO: 1008
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=citrulline
  MISC_FEATURE (19)..(19): PEGylated, 3-(2-(2-(2-(2-(2-(2-(2-(2-(2-(2-(2-(2-aminoethoxy)ethoxy)ethoxy)e thoxy)ethoxy)ethoxy)ethoxy)ethoxy)ethoxy)ethoxy)ethoxy)ethoxy)pro panoic acid
  MISC_FEATURE (28)..(28): xaa=Octahydroindole-2-Carboxylic Acid
  MISC_FEATURE (29)..(29): PEGylated, 3-(2-(2-(2-(2-(2-(2-(2-(2-(2-(2-(2-(2-aminoethoxy)ethoxy)ethoxy)e thoxy)ethoxy)ethoxy)ethoxy)ethoxy)ethoxy)ethoxy)ethoxy)ethoxy)pro panoic acid
  MOD_RES (31)..(31): AMIDATION

SEQ ID NO: 1014 - protein, 31 aa, Artificial Sequence; identical to SEQ ID NO: 1012
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=citrulline
  MISC_FEATURE (19)..(19): PEGylated, 3-(2-(2-(2-(2-(2-(2-(2-(2-(2-(2-(2-(2-aminoethoxy)ethoxy)ethoxy)e thoxy)ethoxy)ethoxy)ethoxy)ethoxy)ethoxy)ethoxy)ethoxy)ethoxy)pro panoic acid
  MISC_FEATURE (28)..(28): xaa=Octahydroindole-2-Carboxylic Acid
  MOD_RES (31)..(31): AMIDATION

SEQ ID NO: 1015 - protein, 31 aa, Artificial Sequence; identical to SEQ ID NO: 1008
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION

SEQ ID NO: 1016-1019 - skipped (4 entries)

SEQ ID NO: 1020 - protein, 31 aa, Artificial Sequence; identical to SEQ ID NO: 1012
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=citrulline
  MISC_FEATURE (28)..(28): xaa=Octahydroindole-2-Carboxylic Acid
  MOD_RES (31)..(31): AMIDATION

SEQ ID NO: 1021 - protein, 31 aa, Artificial Sequence; identical to SEQ ID NO: 1008
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=citrulline
  MISC_FEATURE (28)..(28): xaa=Octahydroindole-2-Carboxylic Acid
  MOD_RES (31)..(31): AMIDATION

SEQ ID NO: 1022 - skipped

SEQ ID NO: 1023 - protein, 31 aa, Artificial Sequence; identical to SEQ ID NO: 130
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (19)..(19): PEGylated, 3-(2-(2-(2-(2-(2-(2-(2-(2-(2-(2-(2-(2-aminoethoxy)ethoxy)ethoxy)e thoxy)ethoxy)ethoxy)ethoxy)ethoxy)ethoxy)ethoxy)ethoxy)ethoxy)pro panoic acid
  MISC_FEATURE (28)..(28): xaa=Octahydroindole-2-Carboxylic Acid
  MOD_RES (31)..(31): AMIDATION

SEQ ID NO: 1024 - protein, 30 aa, Artificial Sequence
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=citrulline
  MISC_FEATURE (19)..(19): PEGylated, 3-(2-(2-(2-(2-(2-(2-(2-(2-(2-(2-(2-(2-aminoethoxy)ethoxy)ethoxy)e thoxy)ethoxy)ethoxy)ethoxy)ethoxy)ethoxy)ethoxy)ethoxy)ethoxy)pro panoic acid
  MISC_FEATURE (27)..(27): xaa=citrulline
  MOD_RES (30)..(30): AMIDATION
WVTHXLAGLLSXSGGVVXKFVPTDVGXFAF

SEQ ID NO: 1025 - protein, 31 aa, Artificial Sequence; identical to SEQ ID NO: 665
  CGRP peptide
  MOD_RES (1)..(1): AMIDATION
  MISC_FEATURE (5)..(5): xaa=citrulline
  MISC_FEATURE (12)..(12): xaa=citrulline
  MISC_FEATURE (18)..(18): xaa=citrulline
  MISC_FEATURE (19)..(19): PEGylated, 3-(2-(2-(2-(2-(2-(2-(2-(2-(2-(2-(2-(2-aminoethoxy)ethoxy)ethoxy)e thoxy)ethoxy)ethoxy)ethoxy)ethoxy)ethoxy)ethoxy)ethoxy)ethoxy)pro panoic acid
  MISC_FEATURE (28)..(28): xaa=Octahydroindole-2-Carboxylic Acid
  MOD_RES (31)..(31): AMIDATION

SEQ ID NO: 1026 - protein, 31 aa, Artificial Sequence
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=citrulline
  MISC_FEATURE (19)..(19): PEGylated, 3-(2-(2-(2-(2-(2-(2-(2-(2-(2-(2-(2-(2-aminoethoxy)ethoxy)ethoxy)e thoxy)ethoxy)ethoxy)ethoxy)ethoxy)ethoxy)ethoxy)ethoxy)ethoxy)pro panoic acid
  MISC_FEATURE (28)..(28): xaa=Octahydroindole-2-Carboxylic Acid
  MOD_RES (31)..(31): AMIDATION
WVTHXLAGLLSXSGGVVXKNFVPTNVGXKAF

SEQ ID NO: 1027 - protein, 31 aa, Artificial Sequence
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION
  MISC_FEATURE (31)..(31): xaa=4-guanidinyl phenylalanine
WVTHXLAGLLSXSGGVVXKNFVPTDVGXKAX

SEQ ID NO: 1028 - protein, 31 aa, Artificial Sequence; identical to SEQ ID NO: 665
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION

SEQ ID NO: 1029 - protein, 31 aa, Artificial Sequence; identical to SEQ ID NO: 1012
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION

SEQ ID NO: 1030-1031 - skipped (2 entries)

SEQ ID NO: 1032 - protein, 31 aa, Artificial Sequence; identical to SEQ ID NO: 130
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=citrulline
  MISC_FEATURE (28)..(28): xaa=Octahydroindole-2-Carboxylic Acid
  MOD_RES (31)..(31): AMIDATION

SEQ ID NO: 1033 - protein, 31 aa, Artificial Sequence; identical to SEQ ID NO: 131
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=citrulline
  MISC_FEATURE (29)..(29): xaa=3-(1-naphthyl)alanine
  MOD_RES (31)..(31): AMIDATION

SEQ ID NO: 1034 - protein, 14 aa, Artificial Sequence
  CGRP peptide
  MOD_RES (1)..(1): ACETYLATION
  MISC_FEATURE (1)..(1): Di-(t-Butyloxycarbonyl derivative)
  MISC_FEATURE (8)..(8): t-Butyl derivative
  MISC_FEATURE (11)..(11): xaa=Octahydroindole-2-Carboxylic Acid
  MISC_FEATURE (12)..(12): t-Butyloxycarbonyl derivative
  MOD_RES (14)..(14): AMIDATION
RKNFVPTDVGXKAF

SEQ ID NO: 1035 - protein, 14 aa, Artificial Sequence
  CGRP peptide
  MISC_FEATURE (1)..(1): Di-(t-Butyloxycarbonyl derivative)
  MISC_FEATURE (8)..(8): t-Butyl derivative
  MISC_FEATURE (11)..(11): xaa=Octahydroindole-2-Carboxylic Acid
  MISC_FEATURE (12)..(12): t-Butyloxycarbonyl derivative
  MOD_RES (14)..(14): AMIDATION
RKNFVPTDVGXKAF

SEQ ID NO: 1036 - protein, 14 aa, Artificial Sequence
  CGRP peptide
  MOD_RES (1)..(1): ACETYLATION
  MISC_FEATURE (1)..(1): Di-(t-Butyloxycarbonyl derivative)
  MISC_FEATURE (3)..(3): t-Butyloxycarbonyl derivative
  MISC_FEATURE (8)..(8): t-Butyl derivative
  MISC_FEATURE (11)..(11): xaa=Octahydroindole-2-Carboxylic Acid
  MOD_RES (14)..(14): AMIDATION
RKKFVPTDVGXKAF

SEQ ID NO: 1037 - protein, 14 aa, Artificial Sequence
  CGRP peptide
  MOD_RES (1)..(1): ACETYLATION
  MISC_FEATURE (1)..(1): Di-(t-Butyloxycarbonyl derivative)
  MISC_FEATURE (3)..(3): t-Butyloxycarbonyl derivative
  MISC_FEATURE (11)..(11): xaa=Octahydroindole-2-Carboxylic Acid
  MOD_RES (14)..(14): AMIDATION
RKKFVPTNVGXKAF

SEQ ID NO: 1038 - protein, 15 aa, Artificial Sequence
  CGRP peptide
  MOD_RES (1)..(1): ACETYLATION
  MISC_FEATURE (1)..(1): Di-(t-Butyloxycarbonyl derivative)
  MISC_FEATURE (2)..(2): Di-(t-Butyloxycarbonyl derivative)
  MISC_FEATURE (9)..(9): t-Butyl derivative
  MISC_FEATURE (12)..(12): xaa=Octahydroindole-2-Carboxylic Acid
  MOD_RES (15)..(15): AMIDATION
RRKNFVPTDVGXKAF

SEQ ID NO: 1039 - protein, 15 aa, Artificial Sequence
  CGRP peptide
  MOD_RES (1)..(1): ACETYLATION
  MISC_FEATURE (12)..(12): xaa=Octahydroindole-2-Carboxylic Acid
  MOD_RES (15)..(15): AMIDATION
RKCKFVPTDVGXKAF

SEQ ID NO: 1040 - protein, 15 aa, Artificial Sequence
  CGRP peptide
  MISC_FEATURE (12)..(12): xaa=Octahydroindole-2-Carboxylic Acid
  MOD_RES (15)..(15): AMIDATION
RKCKFVPTDVGXKAF

SEQ ID NO: 1041-1049 - skipped (9 entries)

SEQ ID NO: 1050 - protein, 15 aa, Artificial Sequence
  CGRP peptide
  MISC_FEATURE (12)..(12): xaa=Octahydroindole-2-Carboxylic Acid
  MOD_RES (15)..(15): AMIDATION
RKCNFVPTDVGXKAF

SEQ ID NO: 1051 - protein, 15 aa, Artificial Sequence
  CGRP peptide
  MISC_FEATURE (12)..(12): xaa=Octahydroindole-2-Carboxylic Acid
  MOD_RES (15)..(15): AMIDATION
RKCKFVPTNVGXKAF

SEQ ID NO: 1052 - protein, 27 aa, Artificial Sequence
  CGRP peptide
  MISC_FEATURE (1)..(1): xaa=citrulline
  MISC_FEATURE (8)..(8): xaa=citrulline
  MISC_FEATURE (24)..(24): xaa=Octahydroindole-2-Carboxylic Acid
  MOD_RES (27)..(27): AMIDATION
XLAGLLSXSGGVVRKNFVPTDVGXFAF

SEQ ID NO: 1053 - protein, 26 aa, Artificial Sequence
  CGRP peptide
  MISC_FEATURE (7)..(7): xaa=citrulline
  MISC_FEATURE (23)..(23): xaa=Octahydroindole-2-Carboxylic Acid
  MOD_RES (26)..(26): AMIDATION
LAGLLSXSGGVVRKNFVPTDVGXFAF

SEQ ID NO: 1054 - protein, 25 aa, Artificial Sequence
  CGRP peptide
  MISC_FEATURE (6)..(6): xaa=citrulline
  misc_feature (22)..(22): Xaa can be any naturally occurring amino acid
  MISC_FEATURE (23)..(23): xaa=Octahydroindole-2-Carboxylic Acid
  MOD_RES (25)..(25): AMIDATION
AGLLSXSGGVVRKNFVPTDVGXFAF

SEQ ID NO: 1055 - protein, 24 aa, Artificial Sequence
  CGRP peptide
  MISC_FEATURE (5)..(5): xaa=citrulline
  MISC_FEATURE (21)..(21): xaa=Octahydroindole-2-Carboxylic Acid
  MOD_RES (24)..(24): AMIDATION
GLLSXSGGVVRKNFVPTDVGXFAF

SEQ ID NO: 1056 - protein, 23 aa, Artificial Sequence
  CGRP peptide
  MISC_FEATURE (4)..(4): xaa=citrulline
  MISC_FEATURE (20)..(20): xaa=Octahydroindole-2-Carboxylic Acid
  MOD_RES (23)..(23): AMIDATION
LLSXSGGVVRKNFVPTDVGXFAF

SEQ ID NO: 1057 - protein, 22 aa, Artificial Sequence
  CGRP peptide
  MISC_FEATURE (3)..(3): xaa=citrulline
  MISC_FEATURE (19)..(19): xaa=Octahydroindole-2-Carboxylic Acid
  MOD_RES (22)..(22): AMIDATION
LSXSGGVVRKNFVPTDVGXFAF

SEQ ID NO: 1058 - protein, 21 aa, Artificial Sequence
  CGRP peptide
  MISC_FEATURE (2)..(2): xaa=citrulline
  MISC_FEATURE (18)..(18): xaa=Octahydroindole-2-Carboxylic Acid
  MOD_RES (21)..(21): AMIDATION
SXSGGVVRKNFVPTDVGXFAF

SEQ ID NO: 1059 - protein, 20 aa, Artificial Sequence
  CGRP peptide
  MISC_FEATURE (1)..(1): xaa=citrulline
  MISC_FEATURE (17)..(17): xaa=Octahydroindole-2-Carboxylic Acid
  MOD_RES (20)..(20): AMIDATION
XSGGVVRKNFVPTDVGXFAF

SEQ ID NO: 1060 - protein, 19 aa, Artificial Sequence
  CGRP peptide
  MISC_FEATURE (16)..(16): xaa=Octahydroindole-2-Carboxylic Acid
  MOD_RES (19)..(19): AMIDATION
SGGVVRKNFVPTDVGXFAF

SEQ ID NO: 1061 - protein, 18 aa, Artificial Sequence
  CGRP peptide
  MISC_FEATURE (15)..(15): xaa=Octahydroindole-2-Carboxylic Acid
  MOD_RES (18)..(18): AMIDATION
GGVVRKNFVPTDVGXFAF

SEQ ID NO: 1062 - protein, 16 aa, Artificial Sequence
  CGRP peptide
  MISC_FEATURE (13)..(13): xaa=Octahydroindole-2-Carboxylic Acid
  MOD_RES (16)..(16): AMIDATION
VVRKNFVPTDVGXFAF

SEQ ID NO: 1063 - protein, 31 aa, Artificial Sequence; identical to SEQ ID NO: 262
  CGRP peptide
  MISC_FEATURE: Lactam bridge between residues 1 and 5.
  MOD_RES (1)..(1): ACETYLATION
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION

SEQ ID NO: 1064 - protein, 31 aa, Artificial Sequence; identical to SEQ ID NO: 263
  CGRP peptide
  MISC_FEATURE: Lactam bridge between residues 2 and 6.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION

SEQ ID NO: 1065 - protein, 31 aa, Artificial Sequence; identical to SEQ ID NO: 180
  CGRP peptide
  MISC_FEATURE: Lactam bridge between residues 3 and 7.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION

SEQ ID NO: 1066 - protein, 31 aa, Artificial Sequence; identical to SEQ ID NO: 265
  CGRP peptide
  MISC_FEATURE: Lactam bridge between residues 4 and 8.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION

SEQ ID NO: 1067 - protein, 31 aa, Artificial Sequence; identical to SEQ ID NO: 266
  CGRP peptide
  MISC_FEATURE: Lactam bridge between residues 5 and 9.
  MOD_RES (1)..(1): ACETYLATION
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION

SEQ ID NO: 1068 - protein, 31 aa, Artificial Sequence; identical to SEQ ID NO: 267
  CGRP peptide
  MISC_FEATURE: Lactam bridge between residues 6 and 10.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION

SEQ ID NO: 1069 - protein, 31 aa, Artificial Sequence; identical to SEQ ID NO: 268
  CGRP peptide
  MISC_FEATURE: Lactam bridge between residues 7 and 11.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION

SEQ ID NO: 1070 - protein, 31 aa, Artificial Sequence; identical to SEQ ID NO: 269
  CGRP peptide
  MISC_FEATURE: Lactam bridge between residues 3 and 7.
  MOD_RES (1)..(1): ACETYLATION
  MISC_FEATURE (5)..(5): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION

SEQ ID NO: 1071 - skipped

SEQ ID NO: 1072 - protein, 31 aa, Artificial Sequence; identical to SEQ ID NO: 271
  CGRP peptide
  MISC_FEATURE: Lactam bridge between residues 10 and 14.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION

SEQ ID NO: 1073 - protein, 31 aa, Artificial Sequence; identical to SEQ ID NO: 272
  CGRP peptide
  MISC_FEATURE: Lactam bridge between residues 11 and 15.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION

SEQ ID NO: 1074 - protein, 31 aa, Artificial Sequence; identical to SEQ ID NO: 273
  CGRP peptide
  MISC_FEATURE: Lactam bridge between residues 12 and 16.
  MOD_RES (1)..(1): ACETYLATION
  MISC_FEATURE (5)..(5): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION

SEQ ID NO: 1075 - protein, 31 aa, Artificial Sequence; identical to SEQ ID NO: 274
  CGRP peptide
  MISC_FEATURE: Lactam bridge between residues 13 and 17.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION

SEQ ID NO: 1076 - protein, 31 aa, Artificial Sequence
  CGRP peptide
  MISC_FEATURE: Lactam bridge between residues 15 and 19.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION
WVTHXLAGLLSXSGEVVXKNFVPTDVGXFAF

SEQ ID NO: 1077 - protein, 31 aa, Artificial Sequence
  CGRP peptide
  MISC_FEATURE: Lactam bridge between residues 16 and 20.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION
WVTHXLAGLLSXSGGEVXKKFVPTDVGXFAF

SEQ ID NO: 1078 - protein, 31 aa, Artificial Sequence; identical to SEQ ID NO: 275
  CGRP peptide
  MISC_FEATURE: Lactam bridge between residues 20 and 25.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION

SEQ ID NO: 1079 - protein, 31 aa, Artificial Sequence; identical to SEQ ID NO: 276
  CGRP peptide
  MISC_FEATURE: Lactam bridge between residues 21 and 26.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION

SEQ ID NO: 1080 - protein, 31 aa, Artificial Sequence; identical to SEQ ID NO: 277
  CGRP peptide
  MISC_FEATURE: Lactam bridge between residues 22 and 27.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION

SEQ ID NO: 1081 - protein, 31 aa, Artificial Sequence; identical to SEQ ID NO: 278
  CGRP peptide
  MISC_FEATURE: Lactam bridge between residues 24 and 29.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION

SEQ ID NO: 1082 - protein, 31 aa, Artificial Sequence; identical to SEQ ID NO: 279
  CGRP peptide
  MISC_FEATURE: Lactam bridge between residues 25 and 30.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION

SEQ ID NO: 1083 - protein, 31 aa, Artificial Sequence; identical to SEQ ID NO: 280
  CGRP peptide
  MISC_FEATURE: Lactam bridge between residues 26 and 31.
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION

SEQ ID NO: 1084-1085 - skipped (2 entries)

SEQ ID NO: 1086 - protein, 31 aa, Artificial Sequence
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (19)..(19): PEGylated, 3-(2-(2-(2-(2-(2-(2-(2-(2-(2-(2-(2-(2-aminoethoxy)ethoxy)ethoxy)e thoxy)ethoxy)ethoxy)ethoxy)ethoxy)ethoxy)ethoxy)ethoxy)ethoxy)pro panoic acid
  MISC_FEATURE (28)..(28): xaa=Octahydroindole-2-Carboxylic Acid
  MOD_RES (31)..(31): AMIDATION
WVTHXLAGLLSXSGGVVXKNFVPTNVGXFAF

SEQ ID NO: 1087-1088 - skipped (2 entries)

SEQ ID NO: 1089 - protein, 31 aa, Artificial Sequence; identical to SEQ ID NO: 130
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=beta-homo proline
  MOD_RES (31)..(31): AMIDATION

SEQ ID NO: 1090 - protein, 31 aa, Artificial Sequence; identical to SEQ ID NO: 130
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=beta-homoarginine
  MISC_FEATURE (28)..(28): xaa=Octahydroindole-2-Carboxylic Acid
  MOD_RES (31)..(31): AMIDATION

SEQ ID NO: 1091 - protein, 31 aa, Artificial Sequence; identical to SEQ ID NO: 283
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MISC_FEATURE (29)..(29): xaa=beta-homo phenylalanine
  MOD_RES (31)..(31): AMIDATION

SEQ ID NO: 1092 - protein, 31 aa, Artificial Sequence; identical to SEQ ID NO: 137
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (21)..(21): xaa=beta-homo phenylalanine
  MISC_FEATURE (28)..(28): xaa=Octahydroindole-2-Carboxylic Acid
  MOD_RES (31)..(31): AMIDATION

SEQ ID NO: 1093 - protein, 31 aa, Artificial Sequence; identical to SEQ ID NO: 137
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (21)..(21): xaa=alpha-methyl phenyalanine
  MISC_FEATURE (28)..(28): xaa=Octahydroindole-2-Carboxylic Acid
  MOD_RES (31)..(31): AMIDATION

SEQ ID NO: 1094 - protein, 31 aa, Artificial Sequence; identical to SEQ ID NO: 286
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION
  MISC_FEATURE (31)..(31): xaa=alpha-methyl phenyalanine

SEQ ID NO: 1095 - protein, 31 aa, Artificial Sequence; identical to SEQ ID NO: 283
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MISC_FEATURE (29)..(29): xaa=alpha-methyl phenyalanine
  MOD_RES (31)..(31): AMIDATION

SEQ ID NO: 1096 - protein, 31 aa, Artificial Sequence; identical to SEQ ID NO: 137
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (21)..(21): xaa=Nalpha-methyl phenylaline
  MISC_FEATURE (28)..(28): xaa=Octahydroindole-2-Carboxylic Acid
  MOD_RES (31)..(31): AMIDATION

SEQ ID NO: 1097 - protein, 31 aa, Artificial Sequence; identical to SEQ ID NO: 286
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MOD_RES (31)..(31): AMIDATION
  MISC_FEATURE (31)..(31): xaa=Nalpha-methyl phenylaline

SEQ ID NO: 1098 - protein, 31 aa, Artificial Sequence; identical to SEQ ID NO: 283
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (28)..(28): xaa=Octahydroindole-2-Carboxylic Acid
  MISC_FEATURE (29)..(29): xaa=Nalpha-methyl phenylaline
  MOD_RES (31)..(31): AMIDATION

SEQ ID NO: 1099 - skipped

SEQ ID NO: 1100 - protein, 15 aa, Artificial Sequence
  CGRP peptide
  MISC_FEATURE (12)..(12): xaa=Octahydroindole-2-Carboxylic Acid
  MOD_RES (15)..(15): AMIDATION
RKCNFVPTDVGXFAF

SEQ ID NO: 1101 - protein, 16 aa, Artificial Sequence
  CGRP peptide
  MISC_FEATURE (13)..(13): xaa=Octahydroindole-2-Carboxylic Acid
  MOD_RES (16)..(16): AMIDATION
RRKCNFVPTDVGXFAF

SEQ ID NO: 1102 - skipped

SEQ ID NO: 1103 - protein, 31 aa, Artificial Sequence
  CGRP peptide
  MOD_RES (1)..(1): ACETYLATION
  MISC_FEATURE (5)..(5): xaa=citrulline
  MISC_FEATURE (12)..(12): xaa=citrulline
  MISC_FEATURE (18)..(18): xaa=homoarginine
  MISC_FEATURE (19)..(19): PEGylated, 3-(2-(2-(2-(2-(2-(2-(2-(2-(2-(2-(2-(2-aminoethoxy)ethoxy)ethoxy)e thoxy)ethoxy)ethoxy)ethoxy)ethoxy)ethoxy)ethoxy)ethoxy)ethoxy)pro panoic acid
  MISC_FEATURE (28)..(28): xaa=D-pro
  MISC_FEATURE (29)..(29): xaa=3-(1-naphthyl)alanine
  MOD_RES (31)..(31): AMIDATION
WVTHXLAGLLSXSGGVVXKNFVPTNVGXXAF

SEQ ID NO: 1104 - protein, 6 aa, Artificial Sequence
  Linker sequence
  MISC_FEATURE (1)..(2): Xaa in positions 1 and 2 are each independently any amino acid residue
  MISC_FEATURE (4)..(5): Xaa in positions 4 and 5 are each independently any amino acid residue
XXNXXG

SEQ ID NO: 1105 - protein, 4 aa, Artificial Sequence
  linker sequence
GGGG

SEQ ID NO: 1106 - protein, 5 aa, Artificial Sequence
  linker sequence
GGGGS

SEQ ID NO: 1107 - protein, 10 aa, Artificial Sequence
  linker sequence
GGGGSGGGGS

SEQ ID NO: 1108 - protein, 25 aa, Artificial Sequence
  linker sequence
GGGGSGGGGSGGGGSGGGGSGGGGS

SEQ ID NO: 1109 - protein, 6 aa, Artificial Sequence
  peptide linker sequence
GGEGGG

SEQ ID NO: 1110 - protein, 8 aa, Artificial Sequence
  peptide linker sequence
GGEEEGGG

SEQ ID NO: 1111 - protein, 5 aa, Artificial Sequence
  peptide linker sequence
GEEEG

SEQ ID NO: 1112 - protein, 4 aa, Artificial Sequence
  peptide linker sequence
GEEE

SEQ ID NO: 1113 - protein, 6 aa, Artificial Sequence
  peptide linker sequence
GGDGGG

SEQ ID NO: 1114 - protein, 7 aa, Artificial Sequence
  peptide linker sequence
GGDDDGG

SEQ ID NO: 1115 - protein, 5 aa, Artificial Sequence
  peptide linker sequence
GDDDG

SEQ ID NO: 1116 - protein, 4 aa, Artificial Sequence
  peptide linker sequence
GDDD

SEQ ID NO: 1117 - protein, 21 aa, Artificial Sequence
  peptide linker sequence
GGGGSDDSDEGSDGEDGGGGS

SEQ ID NO: 1118 - protein, 5 aa, Artificial Sequence
  peptide linker sequence
WEWEW

SEQ ID NO: 1119 - protein, 5 aa, Artificial Sequence
  peptide linker sequence
FEFEF

SEQ ID NO: 1120 - protein, 6 aa, Artificial Sequence
  peptide linker sequence
EEEWWW

SEQ ID NO: 1121 - protein, 6 aa, Artificial Sequence
  peptide linker sequence
EEEFFF

SEQ ID NO: 1122 - protein, 7 aa, Artificial Sequence
  peptide linker sequence
WWEEEWW

SEQ ID NO: 1123 - protein, 7 aa, Artificial Sequence
  peptide linker sequence
FFEEEFF

SEQ ID NO: 1124 - protein, 6 aa, Artificial Sequence
  linker sequence
  MISC_FEATURE (1)..(2): Xaa in positions 1 and 2 are each independently any amino acid residue
  MISC_FEATURE (4)..(5): Xaa in positions 4 and 5 are each independently any amino acid residue
XXYXXG

SEQ ID NO: 1125 - protein, 6 aa, Artificial Sequence
  linker sequence
  MISC_FEATURE (1)..(2): Xaa in positions 1 and 2 are each independently any amino acid residue
  MISC_FEATURE (4)..(5): Xaa in positions 4 and 5 are each independently any amino acid residue
XXSXXG

SEQ ID NO: 1126 - protein, 6 aa, Artificial Sequence
  linker sequence
  MISC_FEATURE (1)..(2): Xaa in positions 1 and 2 are each independently any amino acid residue
  MISC_FEATURE (4)..(5): Xaa in positions 4 and 5 are each independently any amino acid residue
XXTXXG

SEQ ID NO: 1127 - protein, 37 aa, Artificial Sequence
  CGRP peptide
  MISC_FEATURE (1)..(7): Xaa in positions 1-7 are each independently absent or a hydrophobic amino acid residue
  MISC_FEATURE (9)..(9): Xaa in position 9 is a neutral hydrophobic or neutral polar residue
  MISC_FEATURE (10)..(11): Xaa in positions 10-11 are basic amino acid residues
  MISC_FEATURE (18)..(18): Xaa in position 18 is a basic amino acid residue
  MISC_FEATURE (23)..(26): Xaa in positions 23-26 are neutral amino acid residues or basic amino acid residues
  MISC_FEATURE (30)..(30): Xaa in position 30 is a neutral polar amino acid residue
  MISC_FEATURE (31)..(31): Xaa in position 31 is Asn, Lys, Homolysine, Ornithine, 4-carboxy-phenylalanine, 4-Amino-Phe, beta-glutamic acid, beta-Homoglutamic acid, homoglutamic acid, or Asp
  MISC_FEATURE (34)..(34): Xaa in position 34 is a cyclic amino acid residue, a neutral hydrophobic amino acid residue, or a neutral polar amino acid residue.
  MISC_FEATURE (35)..(35): Xaa in position 35 is a neutral hydrophobic or a aromatic amino acid residue
  MISC_FEATURE (37)..(37): Xaa in position 37 is a neutral hydrophobic or a aromatic amino acid residue
XXXXXXXVXXXLAGLLSXSGGVXXXXFVPXXVGXXAX

SEQ ID NO: 1128 - protein, 31 aa, Artificial Sequence; identical to SEQ ID NO: 147
  CGRP peptide
  MOD_RES (31)..(31): AMIDATION

SEQ ID NO: 1129 - protein, 30 aa, Artificial Sequence
  CGRP peptide
  MISC_FEATURE (4)..(4): xaa=citrulline
  MOD_RES (30)..(30): AMIDATION
VTHXLAGLASRPGGVVRKNFVPTDVGPFAF

SEQ ID NO: 1130 - protein, 37 aa, Artificial Sequence
  CGRP peptide
  MISC_FEATURE (1)..(7): Xaa in positions 1-7 are each independently absent or a hydrophobic amino acid residue
  MISC_FEATURE (9)..(9): Xaa in position 9 is a neutral hydrophobic or neutral polar amino acid residue
  MISC_FEATURE (10)..(11): Xaa in positions 10-11 are basic amino acid residues
  MISC_FEATURE (12)..(12): Xaa in position 12 is Leu, Lys, Homolysine, Ornithine, 4-carboxy-phenylalanine, 4-Amino-Phe, beta-glutamic acid, beta-Homoglutamic acid, homoglutamic acid, or Asp
  MISC_FEATURE (13)..(13): Xaa in position 13 is Ala, Lys, Homolysine, Ornithine, 4-carboxy-phenylalanine, 4-Amino-Phe, beta-glutamic acid, beta-Homoglutamic acid, homoglutamic acid, or Asp
  MISC_FEATURE (14)..(14): Xaa in position 14 is Gly, Lys, Homolysine, Ornithine, 4-carboxy-phenylalanine, 4-Amino-Phe, beta-glutamic acid, beta-Homoglutamic acid, homoglutamic acid, or Asp
  MISC_FEATURE (15)..(16): Xaa in positions 15-16 are Leu, Lys, Homolysine, Ornithine, 4-carboxy-phenylalanine, 4-Amino-Phe, beta-glutamic acid, beta-Homoglutamic acid, homoglutamic acid, or Asp
  MISC_FEATURE (17)..(17): Xaa in position 17 is Ser, Lys, Homolysine, Ornithine, 4-carboxy-phenylalanine, 4-Amino-Phe, beta-glutamic acid, beta-Homoglutamic acid, homoglutamic acid, or Asp
  MISC_FEATURE (18)..(18): Xaa in position 18 is a basic amino acid residue
  MISC_FEATURE (19)..(19): Xaa in position 19 is Ser, Lys, Homolysine, Ornithine, 4-carboxy-phenylalanine, 4-Amino-Phe, beta-glutamic acid, beta-Homoglutamic acid, homoglutamic acid, or Asp
  MISC_FEATURE (20)..(20): Xaa in position 20 is Gly, Lys, Homolysine, Ornithine, 4-carboxy-phenylalanine, 4-Amino-Phe, beta-glutamic acid, beta-Homoglutamic acid, homoglutamic acid, or Asp
  MISC_FEATURE (23)..(26): Xaa in positions 23-26 are neutral amino acid residues or basic amino acid residues
  MISC_FEATURE (30)..(30): Xaa in position 30 is a neutral polar amino acid residue
  MISC_FEATURE (31)..(31): Xaa in position 31 is Asn, Lys, Homolysine, Ornithine, 4-carboxy-phenylalanine, 4-Amino-Phe, beta-glutamic acid, beta-Homoglutamic acid, homoglutamic acid, or Asp
  MISC_FEATURE (34)..(34): Xaa in position 34 is a cyclic amino acid residue, a neutral hydrophobic amino acid residue, or a neutral polar amino acid residue
  MISC_FEATURE (35)..(35): Xaa in position 35 is a neutral hydrophobic or aromatic amino acid residue
  MISC_FEATURE (36)..(36): Xaa in position 36 is Ala, Lys, Homolysine, Ornithine, 4-carboxy-phenylalanine, 4-Amino-Phe, beta-glutamic acid, beta-Homoglutamic acid, homoglutamic acid, or Asp
  MISC_FEATURE (37)..(37): Xaa in position 37 is a neutral hydrophobic or aromatic amino acid residue
XXXXXXXVXXXXXXXXXXXXGVXXXXFVPXXVGXXXX

We claim:

1. A composition of matter, comprising a CGRP peptide antagonist comprising an amino acid sequence of the formula:

(SEQ ID NO: 1127)
$Xaa^1Xaa^2Xaa^3Xaa^4Xaa^5Xaa^6Xaa^7V^8Xaa^9Xaa^{10}Xaa^{11}L^{12}A^{13}$
$G^{14}L^{15}L^{16}S^{17}Xaa^{18}S^{19}G^{20}G^{21}V^{22}Xaa^{23}Xaa^{24}Xaa^{25}Xaa^{26}$
$F^{27}V^{28}P^{29}Xaa^{30}Xaa^{31}V^{32}G^{33}Xaa^{34}Xaa^{35}A^{36}Xaa^{37}$ wherein:
$Xaa^1$, $Xaa^2$, $Xaa^3$ $Xaa^4$, $Xaa^5$, $Xaa^6$, and $Xaa^7$, are each independently absent or a hydrophobic amino acid residue selected from Trp, 1-Nal, 2-Nal, Phe, Tyr, Bip, 4-carboxy-phenylalanine, and 4-Amino-Phe;

$Xaa^9$ is a Thr, Ser, Ala, Gly, Val, Leu, or Ile residue;

$Xaa^{10}$ is a His, $N^{\alpha}$-Methyl-His, Lys, Homolysine, Ornithine, or 4-Amino-Phe residue;

$Xaa^{11}$ is an $N^{\alpha}$-Methyl-Arg, homoarginine, Cit, $N^{\alpha}$-Methyl-Cit, Homocitrulline, His, Guf, Lys, Homolysine, Ornithine, or 4-Amino-Phe residue;

$Xaa^{18}$ is an $N^{\alpha}$-Methyl-Arg, homoarginine, Cit, $N^{\alpha}$-Methyl-Cit, Homocitrulline, His, Guf, Lys, Homolysine, Ornithine, or 4-Amino-Phe residue;

$Xaa^{23}$ is a Val, Arg, D-Arg, homoarginine, Lys, D-Lys, homolysine, Orn, Dab, Dpr, homocysteine, or 4-Amino-Phe residue;

Xaa²⁴ is an Arg, D-Arg, Homoarginine, Lys, D-Lys, Homolysine, Orn, Dab, Dpr, Homocysteine, or 4-Amino-Phe residue;

Xaa²⁵ is an Arg, D-Arg, Homoarginine, Lys, D-Lys, Homolysine, Orn, Dab, Dpr, Homocysteine, or 4-Amino-Phe residue;

Xaa²⁶ is an Asn, Arg, D-Arg, Homoarginine, Lys, D-Lys, Homolysine, Orn, Dab, Dpr, Homocysteine, or 4-Amino-Phe residue;

Xaa³⁰ is a Thr, N$^\alpha$-Methyl-Thr, Ser, or N$^\alpha$-Methyl-Ser residue;

Xaa³¹ is an Asn, Lys, Homolysine, Ornithine, 4-carboxy-phenylalanine, 4-Amino-Phe, beta-glutamic acid, beta-Homoglutamic acid, homoglutamic acid, or Asp residue;

Xaa³⁴ is an Oic, Pro, Hyp, Tic, D-Tic, D-Pro, Thz, Aib, Sar, or Pip residue;

Xaa³⁵ is a Phe, D-Phe, Tyr, 1-Nal, 2-Nal, Trp, or Bip residue; and

Xaa³⁷ is a Phe, Tyr, 1-Nal, 2-Nal, Trp, Bip, 4-carboxy-phenylalanine, or 4-Amino-Phe residue.

2. The composition of matter of claim 1, wherein the CGRP peptide antagonist comprises at its N-terminal an acyl, acetyl, benzoyl, benzyloxycarbonyl, benzyl, or dibenzyl moiety.

3. The composition of matter of claim 1, wherein the CGRP peptide antagonist is conjugated to a polyethylene glycol (PEG) at:
(a) 1, 2, 3 or 4 amino functionalized sites of the PEG;
(b) 1, 2, 3 or 4 thiol functionalized sites of the PEG;
(c) 1, 2, 3 or 4 maleimido functionalized sites of the PEG;
(d) 1, 2, 3 or 4 N-succinimidyl functionalized sites of the PEG;
(e) 1, 2, 3 or 4 carboxyl functionalized sites of the PEG; or
(f) 1, 2, 3 or 4 p-nitrophenyloxycarbonyl functionalized sites of the PEG.

4. The composition of matter of claim 1, wherein the CGRP peptide antagonist comprises the amino acid sequence of SEQ ID NO: 658.

5. A composition of matter, comprising a CGRP peptide antagonist comprising the amino acid sequence of SEQ ID NO:658.

6. A pharmaceutical composition, comprising the composition of matter of claim 4 or 5, and a pharmaceutically acceptable carrier.

7. A pharmaceutical composition, comprising the composition of matter of claim 1, and a pharmaceutically acceptable carrier.

8. The composition of matter of claim 5, wherein the CGRP peptide antagonist is conjugated to a polyethylene glycol (PEG) at:
(a) 1, 2, 3 or 4 amino functionalized sites of the PEG;
(b) 1, 2, 3 or 4 thiol functionalized sites of the PEG;
(c) 1, 2, 3 or 4 maleimido functionalized sites of the PEG;
(d) 1, 2, 3 or 4 N-succinimidyl functionalized sites of the PEG;
(e) 1, 2, 3 or 4 carboxyl functionalized sites of the PEG; or
(f) 1, 2, 3 or 4 p-nitrophenyloxycarbonyl functionalized sites of the PEG.

9. A composition of matter, comprising a CGRP peptide antagonist having the amino acid primary sequence of any of those set forth in SEQ ID NOS: 25, 31, 658, 674, 739, 920, or 926.

10. A pharmaceutical composition, comprising the composition of matter of claim 9, and a pharmaceutically acceptable carrier.

11. The composition of matter of claim 9, wherein the CGRP peptide antagonist is conjugated to a polyethylene glycol (PEG) at:
(a) 1, 2, 3 or 4 amino functionalized sites of the PEG;
(b) 1, 2, 3 or 4 thiol functionalized sites of the PEG;
(c) 1, 2, 3 or 4 maleimido functionalized sites of the PEG;
(d) 1, 2, 3 or 4 N-succinimidyl functionalized sites of the PEG;
(e) 1, 2, 3 or 4 carboxyl functionalized sites of the PEG; or
(f) 1, 2, 3 or 4 p-nitrophenyloxycarbonyl functionalized sites of the PEG.

* * * * *